United States Patent
Bridgewater et al.

(10) Patent No.: US 11,986,502 B2
(45) Date of Patent: May 21, 2024

(54) BACTERIOPHAGE COMPOSITIONS AND KITS AND RELATED METHODS

(71) Applicant: BRIGHAM YOUNG UNIVERSITY, Provo, UT (US)

(72) Inventors: Laura Bridgewater, North Provo, UT (US); Gongze Zhao, Highland, UT (US)

(73) Assignee: Optium, LLC, Provo, UT (US)

( * ) Notice: Subject to any disclaimer, the term of this patent is extended or adjusted under 35 U.S.C. 154(b) by 146 days.

(21) Appl. No.: 17/058,020

(22) PCT Filed: May 23, 2019

(86) PCT No.: PCT/US2019/033844
§ 371 (c)(1),
(2) Date: Nov. 23, 2020

(87) PCT Pub. No.: WO2019/226950
PCT Pub. Date: Nov. 28, 2019

(65) Prior Publication Data
US 2021/0196769 A1    Jul. 1, 2021

Related U.S. Application Data

(60) Provisional application No. 62/815,844, filed on Mar. 8, 2019, provisional application No. 62/675,652, filed on May 23, 2018.

(51) Int. Cl.
| | | |
|---|---|---|
| A61K 35/76 | (2015.01) | |
| A61K 35/745 | (2015.01) | |
| A61K 35/747 | (2015.01) | |
| A61K 35/00 | (2006.01) | |

(52) U.S. Cl.
CPC ............ *A61K 35/76* (2013.01); *A61K 35/745* (2013.01); *A61K 35/747* (2013.01); *A61K 2035/115* (2013.01)

(58) Field of Classification Search
None
See application file for complete search history.

(56) References Cited

U.S. PATENT DOCUMENTS

| | | |
|---|---|---|
| 2011/0123501 A1 | 5/2011 | Chou et al. |
| 2015/0297648 A1 | 10/2015 | Deaton et al. |
| 2016/0184370 A1 | 6/2016 | McKenzie et al. |

FOREIGN PATENT DOCUMENTS

| | | |
|---|---|---|
| EP | 2799063 A1 | 11/2014 |
| KR | 10-2016-0005728 A | 1/2016 |
| KR | 10-1670048 B1 | 10/2016 |
| WO | 03/00274 A2 | 1/2003 |
| WO | 2015/104388 A1 | 7/2015 |
| WO | 2016003307 A1 | 1/2016 |
| WO | 2019048930 A2 | 3/2019 |

OTHER PUBLICATIONS

Rhoads DD, Wolcott RD, Kuskowski MA, Wolcott BM, Ward LS, Sulakvelidze A. Bacteriophage therapy of venous leg ulcers in humans: results of a phase I safety trial. J Wound Care. Jun. 2009; 18(6):237-8, 240-3. doi: 10.12968/jowc.2009.18.6.42801. PMID: 19661847.*
GenBank accession NC_023561.1. Mar. 4, 2014.*
GenBank accession KX534339.1. Aug. 8, 2016.*
GenBank accession KY780482.1. May 6, 2017.*
GenBank accession MF285620.1. Sep. 17, 2017.*
Mishra CK, Choi TJ, Kang SC. Isolation and characterization of a bacteriophage F20 virulent to Enterobacter aerogenes. J Gen Virol. Oct. 2012;93(Pt 10):2310-2314. doi: 10.1099/vir.0.043562-0. Epub Jul. 4, 2012. PMID: 22764320.*
Parvataneni S, Mijalis EM, Kuty Everett GF, Rasche ES, Liu M, Gill JJ. Complete Genome Sequence of Citrobacter freundii Myophage Mijalis. Genome Announc. Aug. 3, 2017;5(31): e00228-17. doi: 10.1128/genomeA.00228-17. PMID: 28774966; PMCID: PMC5543628.*
GenBank accession LT614807. Sep. 15, 2016.*
Andrezal et al., Characterization and the host specificity of Pet-CM3-4, a new phage infecting Cronobacter and Enterobacter strains , 2023, Virus Research, vol. 324, pp. 1-9.*
Genbank Accession NC_049834, Jan. 10, 2023.*
International Search Report dated Jul. 23, 2018, issued in PCT Application No. PCT/US2018/022419, filed Mar. 14, 2018.
J. G. Zhao et al., Combating Obesity Through Gut Microbiome Targeted Bacteriophage Therapy, Library Undergraduate Poster Competition 2017, Mar. 18, 2017, p. 1.

(Continued)

*Primary Examiner* — Janet L Andres
*Assistant Examiner* — Jeffrey Mark Sifford
(74) *Attorney, Agent, or Firm* — Workman Nydegger

(57) ABSTRACT

Compositions for affecting the intestinal microbiome of a mammalian subject can include a pharmaceutically-acceptable carrier and greater than or equal to $1\times10^4$ PFU/mL or PFU/mg of bacteriophage having a tropism that includes an obesogenic and/or inflammatory bacterium associated with an intestinal microbiome of a mammal. Processes for preparing the disclosed compositions can include isolating the bacteriophage from an environmental source, characterizing the bacteriophage, and combining the bacteriophage with the pharmaceutically acceptable carrier at greater than or equal to $1\times10^4$ PFU/mL or PFU/mg. Methods can include administering the disclosed compositions to a mammalian subject with or without co-administration of the disclosed probiotics. Administering the disclosed compositions can reduce a concentration of obesogenic and/or inflammatory bacteria in the intestinal microbiome of the mammalian subject, promote or induce weight loss, reduce inflammation, support metabolic health, and/or support a healthy balance/diversity within the intestinal microbiome of the mammalian subject.

20 Claims, 8 Drawing Sheets
Specification includes a Sequence Listing.

(56) References Cited

OTHER PUBLICATIONS

Magdalena et al., "Human Microbiome: When a Friend Becomes an Enemy", Archivum Immunologiae ET Therapiae Experimentalis, vol. 63, No. 4, Feb. 15, 2015, pp. 287-298.
N. Fei et al., An Opportunistic Pathogen Isolated from the Gut of an Obese Human Cases Obesity in Germfree Mice, the ISME Journal, 2012, pp. 1-5.
Written Opinion dated Jul. 23, 2018, issued in PCT Application No. PCT/US2018/022419, filed Mar. 14, 2018.
Y. Xu et al., Bacteriophage Therapy Against Enterobacteriaceae, Virologica Sinica, Feb. 2015, vol. 30, No. 1, pp. 11-18.
Gogokhia et al. Expansion of Bacteriophages Is Linked to Aggravated Intestinal Inflammation and Colitis, Cell Host & Microbe 25, 285-299. e1-e8, Feb. 13, 2019.
Parmar et al. Genomic characterization of key bacteriophages to formulatethe potential biocontrol agent to combat enteric pathogenic bacteria, Archives of Microbiology, 2018, 200, p. 611-622.
European Search Report dated Mar. 21, 2022, issued in PCT Application No. PCT/US2019033844.

\* cited by examiner

| Host bacterium | Phage Name | Bacteria Tested Against ||||||||
|---|---|---|---|---|---|---|---|---|---|
| | | Enterobacter cloacae | Escherichia coli | Serratia marcescens | Klebsiella pneumoniae | Enterobacter aerogenes | Kluyvera ascorbata | Citrobacter freundii | Yokenella regensburgei |
| E. cloacae | Opt-126 | X | X | | | X | X | | X |
| | Opt-712 | X | | | | | | | |
| | Opt-125 | X | | | | | | | |
| | Opt-18 | X | | | | | | | |
| | Opt-38 | X | | | | | | | |
| E. coli | Opt-719 | | X | | X | X | | | |
| | Opt-212 | | X | | X | | | | |
| | Opt-819 | | X | | X | | | | |
| S. marcescens | Opt-162 | | | X | | | | | |
| | Opt-155 | | | X | | | | | |
| | Opt-169 | | | X | | | | | |
| | Opt-148 | | | X | | | | | |
| K. pneumoniae | Opt-817 | | X | | X | | | | |
| | Opt-79 | X | | | X | | | | |
| | Opt-12 | X | | | X | | | | |
| E. aerogenes | Opt-747 | | | | | X | | | |
| | Opt-82 | | | | | X | | | |
| | Opt-35 | | | | | X | | | |
| | Opt-688 | | | | | X | | | |
| | Opt-971 | | X | | | X | X | | |
| | Opt-27 | | | | | X | | | |
| K. ascorbata | Opt-121 | | | | | | X | X | X |
| | Opt-67 | | | | | | X | X | X |
| | Opt-531 | | | | | | X | X | X |
| | Opt-502 | | | | | | X | X | X |
| C. freundii | Opt-574 | | | | | | | X | |
| | Opt-219 | | | | | | | X | |
| | Opt-716 | | | | | | X | X | |
| | Opt-225 | | | | | | | X | |
| | Opt-117 | | | | | | | X | |
| | Opt-24 | | X | | | | | X | |
| Y. regensburgeii | Opt-304 | | | | | | X | | X |
| | Opt-835 | | | | | | X | | X |
| | Opt-812 | | | | | | X | | X |
| | Opt-46 | | | | | | X | | X |
| | Opt-116 | | | | | | X | | X |
| | Opt-356 | | | | | | | | X |

FIG. 3

BACTERIOPHAGE COMPOSITIONS AND KITS AND RELATED METHODS

CROSS-REFERENCE TO RELATED APPLICATIONS

This application is a nationalization of international application Ser. No. PCT/US2019/033844, filed May 23, 2019, which claims priority to and the benefit of U.S. Provisional Patent Application Ser. No. 62/675,652, filed May 23, 2018 and titled "METHODS AND COMPOSITIONS FOR TREATING CHRONIC DISEASES WITH BACTERIOPHAGES" and to U.S. Provisional Patent Application Ser. No. 62/815,844, filed Mar. 8, 2019 and titled "PHAGE COMPOSITIONS AND METHODS OF USE." Each of the foregoing are incorporated herein by this reference in their entirety.

TECHNICAL FIELD

The present disclosure generally relates to compositions that include one or more bacteriophages, kits including the same, and methods for preparing such compositions and for using or administering such compositions to impact the number or concentration of bacteria within the intestinal microbiome of a mammalian subject, preferably to promote or induce weight loss, reduce inflammation, support metabolic health, and/or support a healthy balance/diversity within the gut microbiome.

BACKGROUND

Obesity has become an epidemic worldwide. Overweight and obesity rates in the United States have increased dramatically over the past few decades, culminating in 37% of Americans (i.e., 120 million people) qualifying as obese. In the United States the prevalence of obesity was 35% among men and 40% among women in 2013 to 2014. Another 34% of American adults are overweight. Six percent of American adults are morbidly obese, which is a 400% increase since 1986. Among children and adolescents, the prevalence of obesity is 17%. Obesity is often accompanied by chronic low-level inflammation and is the major contributor to many other chronic illnesses such as type 2 diabetes, insulin resistance, pre-diabetes, heart disease, stroke, fatty liver disease, kidney disease, osteoarthritis, depression, anxiety, certain cancers, and/or other conditions that often result in diminished quality of life and skyrocketing healthcare costs.

In an effort to increase their quality of life, some overweight or obese individuals have adopted a restricted calorie diet and/or increased their physical activity, such as by participating in a cardiovascular fitness regimen. However, certain physical limitations can hamper an individual's efforts to lose weight. For example, some overweight or obese individuals have difficulty increasing the level or intensity of their physical activity due to complications or secondary effects of their size and weight. For some overweight or obese individuals, their weight loss progress is unexpectedly slow or at times non-existent—even with strict adherence to diet and exercise programs.

Recent evidence has suggested that other factors outside of diet and exercise may play a role in an individual's ability to promote or induce weight loss. For example, an individual may be genetically predisposed to having a higher body mass index and/or poor metabolism. Environmental pressures may compound genetic predispositions and play a role in an individual's ability to promote or induce weight loss. Recently it has been hypothesized that an individual's ability to absorb digested nutrients can impact their health and wellness and may influence the effectiveness of dieting or other weight loss programs.

More recently, scientists have been able to identify correlations between the metabolic potential of mammals and the diversity and makeup of their respective intestinal microbiome. For example, seminal studies in mice have correlated pregnancy-induced insulin resistance with the makeup and diversity of the mouse's intestinal microbiome. Fecal transplants between pregnant mice exhibiting pregnancy-induced insulin resistance and non-pregnant mice having normal or baseline insulin sensitivity caused the non-pregnant mice to exhibit signs and symptoms of pregnancy-induced insulin resistance—similar to their pregnant counterparts. In another study, fecal transplants from obese mice to healthy, average weight mice caused the average weight mice to gain weight even though the mice were maintained on the same diet.

These studies and others have implicated the intestinal microbiome as playing a role in our digestive and metabolic health. Unfortunately, it has proven difficult to tease apart the complex interplay between the state of an individual's intestinal microbiome and the respective effects that may have on their physiology and metabolism. The intestinal microbiome is a complex ecosystem of bacteria, fungi, and viruses existing in different physiological states and structures. Bacteria within the intestinal microbiome, for example, can exist as planktonic cells or as structured communities of monoclonal—or even polyclonal—biofilms. Additionally, some bacterial species may localize to distinct regions within the gut, and the practical implications of the spatial organization of gut-associated microbes is poorly understood. Further complicating matters, the makeup and diversity of gut-associated microbes varies between individuals, and few commonalities or predictive features of a "healthy" intestinal microbiome are known.

Most research in this area has relied on whole fecal transplants between hosts to identify global correlations between physiological states and the content and diversity of associated intestinal microbiomes. This is due, in part, to the expansive diversity and proportional concentration of microbes that make up the intestinal microbiome of mammals. Many of the intestinal microbiota are not culturable using known laboratory conditions and media, which further complicates their identification and tractable contribution to the host's physiology or metabolism. Thus, while the study of the intestinal microbiome has provided some provocative insights, there is a lack of tools to specifically augment the membership or concentration of a selective cohort of microbes within the mammalian microbiome. This is painfully evident with respect to the lack of tools and methods available for transforming the mammalian microbiome from an undesirable state to a desirable state.

For example, aspects of the microbiome have been shown to correlate with weight (e.g., body mass index, BMI) and obesity. Cohorts of bacteria associated with the intestinal microbiome have been correlated with "healthy" individuals having an average or ideal BMI, while other bacteria associated with the intestinal microbiome have been correlated with "unhealthy" overweight or obese individuals. However, there is a dearth of compositions, methods, and/or kits for reducing or eliminating microbes associated with obesity and/or for increasing the prevalence of "beneficial" microbes associated with non-obese individuals.

Accordingly, there are a number of disadvantages associated with currently available compositions, methods, and kits that can be addressed, and there is a need for targeted approaches of meaningfully affecting changes to the microbiome to improve the health and well-being of individuals, particularly with respect to weight gain, obesity, and the deleterious consequences associated therewith.

SUMMARY

Embodiments of the present disclosure solve one or more of the foregoing or other problems in the art with compositions, methods, and kits for affecting changes to the intestinal microbiome. In particular, aspects (or embodiments) of the present disclosure relate to methods, systems, and compositions for reducing the amount or concentration of one or more bacterium and, in certain aspects, increasing the amount or concentration of one or more additional bacterium, in the intestinal microbiome of a mammalian, preferably human, subject. Specifically, aspects of the present disclosure relate to methods, systems, and compositions for treating one or more conditions resulting, at least in part, from the overpopulation of the one or more bacterium and/or the underpopulation of the one or more additional bacterium in the gut of said subject. Such conditions can include, for example, (i) obesity (or over-weight), (ii) one or more obesity-(or over-weight-) associated condition (e.g., (metabolic, chronic, and/or acute) illnesses, disorders, and/or diseases), (iii) inflammation, particularly low-level, systemic inflammation, and/or (iv) one or more inflammation-associated conditions (e.g., (metabolic, chronic, and/or acute) illnesses, disorders, and/or diseases). Embodiments include one or more bacteriophage, and compositions or kits comprising the same, and processes for preparing and using said compositions or kits.

Aspects of the present disclosure include a composition comprising an amount of one or more bacteriophage and a pharmaceutically acceptable carrier or excipient.

The composition, or bacteriophage thereof, of various aspects of the present disclosure can be useful and/or effective for altering or to alter the intestinal microbiome or the composition of the intestinal microbiome of a mammalian subject when the composition is administered to the subject in a manner that delivers or disposes the composition, or the one or more bacteriophage thereof, into the gut or intestinal microbiome of the subject. For example, the composition, or bacteriophage thereof, can be useful and/or effective for reducing the concentration of one or more bacterium in the intestinal microbiome of the subject, when administered to the subject in a manner that delivers or disposes the composition, or the one or more bacteriophage thereof, into the gut or intestinal microbiome of the subject. In certain aspects, the one or more bacterium can include at least one species or strain of obesogenic, inflammatory, and/or other bacteria. The one or more bacteriophage can have tropism for (or that includes) the one or more (obesogenic, inflammatory, and/or other) bacterium, or species or strain thereof.

In at least one aspect, reducing the concentration of the one or more obesogenic, inflammatory, and/or other bacteria in the intestinal microbiome of the subject can be effective to: induce, promote, and/or support weight loss; treat obesity (or over-weight) and/or one or more obesity-associated condition; promote or support weight management; support metabolic health; support a healthy balance and/or diversity within the gut microbiome, treat and/or reduce (low-level, systemic) inflammation, reduce the presence and/or concentration of inflammatory markers; and/or treat one or more condition associated with (low-level systemic) inflammation, in the subject. In some aspects, a condition associated with obesity and/or associated with (low-level systemic) inflammation can include one or more of type 2 diabetes, insulin resistance, pre-diabetes, heart disease, stroke, fatty liver disease, kidney disease, osteoarthritis, depression, anxiety, certain cancers, and/or other disorder, illness, disease, and/or condition, including metabolic and/or acute disorders, illnesses, and/or diseases. Accordingly, aspects of the present disclosure relate to compositions for use in treating (i) obesity and/or one or more obesity-associated condition in the subject, (ii) inflammation and/or one or more condition associated with (low-level systemic) inflammation in the subject, (iii) over-population of one or more bacterium in the intestinal microbiome of the subject, and (iv) combinations thereof.

In at least one aspect, reducing the concentration of the one or more obesogenic, inflammatory, and/or other bacteria in the intestinal microbiome of the subject can be effective to: increase energy and/or improve stamina, improve regularity and ease of bowel movements (with softer stools and/or reduced/less-frequent constipation), reduce appetite/food cravings, improve muscle tone, reduce inches around arms and/or waist, improve complexion and/or reduced acne, improve mood, reduce feeling of depression, improve concentration, mental awareness and/or focus, reduce and/or alleviate chronic stomach pain, and/or improve overall well-being. Accordingly, compositions of the present disclosure can be used to treat a variety of conditions, ranging from obesity (or over-weight), stomach pain, constipation, and food cravings, to low-energy or stamina, impaired mental focus, depression/mood disorders, and ache/skin conditions.

One or more aspects (or embodiments) of the present disclosure include a composition having a pharmaceutically-acceptable carrier and one or more bacteriophage, the one or more bacteriophage being included in the composition in any suitable amount and/or concentration. For example, one or more bacteriophage can be included in the composition in an amount and/or concentration effective to reduce the concentration of one or more (target or host) bacterium of the one or more bacteriophage when the composition is administered to a mammalian, preferably human, subject in a manner that delivers or disposes the composition, or one or more bacteriophage thereof, into the gut or intestinal microbiome of the subject. Illustratively, the composition can have or comprise (i) greater than or equal to $1 \times 10^4$ of the one or more bacteriophage, (ii) greater than or equal to $1 \times 10^4$ plaque forming units of the one or more bacteriophage, (iii) greater than or equal to $1 \times 10^4$ PFU per milliliter (PFU/mL) of the one or more bacteriophage, and/or (iv) greater than or equal to $1 \times 10^4$ PFU per milligram (PFU/mg) of the one or more bacteriophage. As used herein, the "effective" amount can be or comprise any of the foregoing or other specific amounts or concentrations.

In certain aspects, the one or more bacteriophage (of the composition) has a tropism for or that includes the one or more species or strain of bacterium. Illustratively, the one or more bacteriophage can have a tropism for or that includes a single species or strain of bacterium, or a plurality of (e.g., closely-related) bacterium. In other aspects, the one or more bacteriophage can have a tropism for or that includes a plurality of bacterium that are not closely related.

In some aspects, the composition includes one, or a single (strain of) bacteriophage. The single (strain of) bacteriophage can a tropism for or that includes a single species or strain of bacterium, or a plurality of bacterium. In other aspects, the composition includes a plurality of (strains of) bacteriophage. In at least one aspect, the plurality of (strains of) bacteriophage can include a first (strain of) bacteriophage, a second (strain of) bacteriophage, an optional third, fourth, fifth, sixth, and so forth, (strains of) bacteriophage. The plurality of (strain of) bacteriophage can each have a tropism for or that includes a single (species or strain of) bacterium, or a plurality of (species or strains of) bacteria. The single (species or strain of) bacterium can be the same bacterium or different bacterium. The plurality of (species or strains of) bacteria can be the same plurality of bacteria or different bacteria. Illustratively, the first (strain of) bacteriophage can have a tropism for or that includes a single (species or strain of) bacterium, or a plurality of (species or strains of) bacteria, and the second (strain of) bacteriophage can have a tropism for or that includes the same or a different single (species or strain of) bacterium, or the same or a different plurality of (species or strains of) bacteria.

In at least one aspect, a mixture (or cocktail) of bacteriophages can be selected to include in a composition of the present disclosure. The cocktail of bacteriophages can be configured for, adapted for, or otherwise capable of targeting, infecting, and killing (e.g. lysing) includes a single (species or strain of) bacterium, or a plurality of (species or strains of) bacteria. Redundancy or overlap in tropism may be desirable in some aspects of the present disclosure. Variety and diversity in tropism may be desirable in some aspects of the present disclosure. For example, some subjects may have an imparlance in a single species or strain of bacterium in their gut microbiome, while other may have an imparlance in a plurality of species or strains of bacteria in their gut microbiome. Different combinations or two or more bacteriophage can be selected to target the single or plurality of bacteria. Moreover, the bacteria may be adapted to or capable of mutating to escape targeting, infection, or destruction by one or more strains of bacteriophage. Accordingly, compositions according to some aspects of the present disclosure include at least two bacteriophage have tropism for the same bacterium or at least some of the same bacteria, but preferably through different (genetic or tropic) mechanisms of action.

In at least one aspect, the composition comprises a pharmaceutically-acceptable carrier and an amount of one or more bacteriophage. The amount of the one or more bacteriophage can be (i) an amount effective to reduce the concentration of one or more target bacterium of the one or more bacteriophage when the composition is administered to a mammalian, preferably human, subject in a manner that delivers or disposes the composition, or one or more bacteriophage thereof, into the gut or intestinal microbiome of the subject, (ii) greater than or equal to $1\times10^4$ of the one or more bacteriophage, (iii) greater than or equal to $1\times10^4$ plaque forming units of the one or more bacteriophage, (iv) greater than or equal to $1\times10^4$ PFU per milliliter (PFU/mL) of the one or more bacteriophage, (v) and/or greater than or equal to $1\times10^4$ PFU per milligram (PFU/mg) of the one or more bacteriophage. The one or more bacteriophage can have a tropism that comprises, or exhibits a specific infectivity to, one or more target bacterium associated with the intestinal microbiome of the subject. The one or more target bacterium can be or comprise one or more obesogenic and/or inflammatory bacterium associated with an intestinal microbiome of a mammal.

In at least one aspect, the composition comprises a pharmaceutically-acceptable carrier and an amount of two or more bacteriophage. The amount of each of the two or more bacteriophage can be (i) an amount effective to reduce the concentration of one or more target bacterium of each of the two or more bacteriophage when the composition is administered to a mammalian, preferably human, subject in a manner that delivers or disposes the composition, or two or more bacteriophage thereof, into the gut or intestinal microbiome of the subject, (ii) greater than or equal to $1\times10^4$ of each of the two or more bacteriophage, (iii) greater than or equal to $1\times10^4$ plaque forming units of each of the two or more bacteriophage, (iv) greater than or equal to $1\times10^4$ PFU per milliliter (PFU/mL) of each of the two or more bacteriophage, (v) and/or greater than or equal to $1\times10^4$ PFU per milligram (PFU/mg) of each of the two or more bacteriophage. Each of the two or more bacteriophage can have a tropism that comprises, or exhibit a specific infectivity to, one or more target bacterium associated with the intestinal microbiome of the subject. The one or more target bacterium can be or comprise one or more obesogenic and/or inflammatory bacterium associated with an intestinal microbiome of a mammal. The tropism of each of the two or more bacteriophage can be a similar or same tropism, or a different tropism, than any one or more other bacteriophage of the composition.

In one aspect, the composition comprises a pharmaceutically-acceptable carrier and greater than or equal to $1\times10^6$ or $1\times10^6$ PFU, etc. of (each of) a plurality of bacteriophages, the plurality of bacteriophages comprising two or more of, preferably each of, Optium-12, Optium-18, Optium-38, Optium-79, Optium-125, Optium-126, Optium-148, Optium-155, Optium-162, Optium-169, Optium-212, Optium-712, Optium-719, Optium-712, and Optium-819, corresponding to corresponding to SEQ ID NOs 1-15 of the present disclosure. In one aspect, the composition comprises a pharmaceutically-acceptable carrier and greater than or equal to $1\times10^8$ or $1\times10^8$ PFU, etc. of each of a plurality of bacteriophages, the plurality of bacteriophages comprising, consisting of, or consisting essentially of Optium-12, Optium-18, Optium-38, Optium-79, Optium-125, Optium-126, Optium-148, Optium-155, Optium-162, Optium-169, Optium-212, Optium-712, Optium-719, Optium-712, and Optium-819, corresponding to corresponding to SEQ ID NOs 1-15 of the present disclosure.

One or more embodiments of the present disclosure include a composition having a pharmaceutically-acceptable carrier and greater than or equal to $1\times10^4$ plaque forming units per milliliter (PFU/mL), per milligram (PFU/mg), or other suitable unit of measurement, of one or more bacteriophage that has a tropism that includes one or more obesogenic bacterium associated with an intestinal microbiome of a mammal. In at least one aspect of the composition, the tropism of the one or more bacteriophage comprises *Enterobacter cloacae*, preferably *Enterobacter cloacae* strain B29. In at least one aspect of the composition, the one or more bacteriophage comprises Optium-18, Optium-38, Optium-125, Optium-126, and/or Optium-712.

In at least one aspect of the composition, the one or more bacteriophage comprises Optium-12, Optium-18, Optium-38, Optium-79, Optium-125, Optium-126, Optium-148, Optium-155, Optium-162, Optium-169, Optium-212, Optium-712, Optium-719, Optium-712 and/or Optium-819.

In one additional aspect the one or more bacteriophage comprises Optium-17, Optium-34, Optium-86, Optium-88, Optium-113, Optium-118, Optium-125, and/or Optium-417.

In at least one aspect, the one or more bacteriophage of the composition has a tropism that comprises one or more of *Escherichia coli, Serratia marcescens, Klebsiella pneumoniae, Enterobacter aerogenes* (also classified as *Klebsiella aerogenes*), *Citrobacter freundii, Kluyvera ascorbata*, and *Yokenella regensburgei*.

In at least one aspect, the one or more bacteriophage are classified or typed as, or have a classification selected from the group consisting of: Myoviridae, preferably (i) T4-like, more preferably sub cluster G, I, or a new or unknown subcluster type, or (ii) RV5-like, more preferably subcluster C or a new or unknown subcluster type; Podoviridae, preferably T7-like, more preferably subcluster B or a new or unknown subcluster type; Siphoviridae, preferably (i) S01-like, more preferably subcluster A or a new or unknown subcluster type, (ii) 9g-like, more preferably subcluster B or a new or unknown subcluster type, (iii) T1-like, more preferably subcluster B, D, or a new or unknown subcluster type; Jello cluster, preferably subcluster A, B, or a new or unknown subcluster type; FaintSaint cluster; and Phage T1-like.

In at least one aspect, the one or more bacteriophage is lytic.

In at least one aspect, the pharmaceutically-acceptable carrier and the one or more bacteriophage form an aqueous solution further comprising salt, peptides, and/or yeast extract.

In at least one aspect, the aqueous solution comprises greater than or equal to 0.5 mg/mL salts, greater than 0.5 mg/mL peptides, and greater than 0.25 mg/mL yeast extract.

In at least one aspect, the one or more bacteriophage is present (in the composition) at a concentration greater than or equal to $1\times10^5$, $1\times10^6$, $1\times10^7$, $1\times10^8$, $1\times10^9$, or $1\times10^{10}$ PFU/mL or PFU/mg.

In at least one aspect, the composition further comprises greater than or equal to $1\times10^4$ (or $1\times10^5$, etc.) PFU/mL or PFU/mg of one or more additional bacteriophage having a respective tropism that comprises one or more additional bacterium associated with the intestinal microbiome of a mammal. In at least one aspect, the one or more additional bacterium comprises one or more of: *Enterobacter cloacae*, *Escherichia coli*, *Serratia marcescens*, *Klebsiella pneumoniae*, *Enterobacter aerogenes*, *Kluyvera ascorbata*, *Citrobacter freundii*, or *Yokenella regensburgei*. In at least one aspect of the composition, the one or more additional bacterium comprises one or more of *Clostridium ramosum* or *Bilophila wadsworthia*.

In at least one aspect, the one or more bacteriophage comprises one or more of: a first bacteriophage having a tropism that comprises at least *Enterobacter cloacae*, a second bacteriophage having a tropism that comprises at least *Klebsiella pneumoniae*, a third bacteriophage having a tropism that comprises at least *Escherichia coli*, or a fourth bacteriophage having a tropism that comprises at least *Serratia marcescens*. In at least one aspect of the foregoing composition, the first bacteriophage can include one or more of Optium-18, Optium-38, Optium-125, Optium-126, and/or Optium-712; the second bacteriophage can include one or more of Optium-12, Optium-79, and/or Optium-817; wherein the third bacteriophage can include one or more of Optium-212, Optium-719, and/or Optium-819; and/or the fourth bacteriophage can include one or more of Optium-148, Optium-155, Optium-162, and/or Optium-169.

In at least one aspect, the one or more bacteriophage comprises one or more of a fifth bacteriophage having a tropism that comprises at least *Enterobacter aerogenes* (also classified as *Klebsiella aerogenes*), a sixth bacteriophage having a tropism that comprises at least *Kluyvera ascorbata*, a seventh bacteriophage having a tropism that comprises at least *Citrobacter freundii*, and/or an eighth bacteriophage having a tropism that comprises at least *Yokenella regensburgei*.

Methods of the present disclosure can also include a process for preparing the disclosed compositions. Aspects of the disclosed methods for preparing the compositions can include aspects of the compositions disclosed herein. In at least one aspect, a method for preparing the disclosed compositions includes isolating the one or more bacteriophage from an environmental source, characterizing the one or more bacteriophage, and combining the one or more bacteriophage with the pharmaceutically acceptable carrier at greater than or equal to $1\times10^4$ (or $1\times10^5$, etc.) PFU/mL or PFU/mg.

In at least one aspect, the one or more bacteriophage has a genome with greater than or equal to 80% sequence identity to one of SEQ ID NOs 1-19, preferably one or SEQ ID NOs 1-15. In at least one aspect, the one or more bacteriophage has a genome with greater than or equal to 85%, 88%, 90%, 92%, 94%, 95%, 96%, 97%, 98%, or 99% sequence identity to one of SEQ ID NOs 1-19, preferably one or SEQ ID NOs 1-15. Alternatively, the one or more bacteriophage can have a genome with a tropic element having greater than or equal to 80%, 85%, 88%, 90%, 92%, 94%, 95%, 96%, 97%, 98%, or 99% sequence identity to a tropic element of one of SEQ ID NOs 1-19, preferably one or SEQ ID NOs 1-15.

In at least one aspect of the method, characterizing the one or more bacteriophage can include measuring a lytic activity of the one or more bacteriophage to determine that the one or more bacteriophage is not lysogenic and determining a tropism for the one or more bacteriophage. In at least one aspect the tropism comprises a narrow host range that includes the one or more obesogenic, inflammatory, and/or other bacterium.

In at least one aspect of the method, characterizing the one or more bacteriophage can additionally or alternatively include sequencing the genome of the one or more bacteriophage and excluding from the composition any bacteriophage having a genome that comprises a toxin or virulence factor gene or an integrase gene. One aspect of the foregoing methods can include determining, based on the sequenced genome, a relatedness of the one or more bacteriophage to a second bacteriophage having a related tropism.

In at least one aspect of the method, combining the one or more bacteriophage with the pharmaceutically acceptable carrier includes combining a plurality of bacteriophages with the pharmaceutically acceptable carrier where the plurality of bacteriophages comprises at least a first set of bacteriophages sharing a tropism that includes the one or more obesogenic, inflammatory, and/or other bacterium. In at least one aspect of the foregoing method, the first set of bacteriophages comprises two bacteriophages having a different host cell receptor specificity for attachment and/or that have less than or equal to 97% genomic sequence identity, preferably less than or equal to 90% genomic sequence identity, or more preferably less than or equal to 80% genomic sequence identity.

Kits of the present disclosure can include a composition and a probiotic and/or prebiotic. In at least one aspect of the kit, the composition includes a pharmaceutically-acceptable carrier and greater than or equal to $1\times10^4$ (or $1\times10^5$, etc.) PFU/mL or PFU/mg of one or more bacteriophage having a tropism that comprises one or more obesogenic, inflammatory, and/or other bacterium associated with an intestinal microbiome of a mammal.

In at least one aspect of the kit, the probiotic comprises a mixture of bacteria comprising *Bifidobacterium* sp. and *Lactobacillus* sp.

In at least one aspect of the kit, the probiotic comprises one or more of: *Lactobacillus rhamnosus, Lactobacillus reuteri, Bacteroides fragilis, Bifidobacterium breve, Bifidobacterium longum, Bifidobacterium pseudocatenulatum*. In at least one aspect, the probiotic of the kit can additionally or alternatively include one or more of: *Lactobacillus acidophilus, Lactobacillus brevis, Lactobacillus casei, Lactobacillus salivarius, Lactobacillus lactis, Bifidobacterium bifidum*, or *Bifidobacterium lactis*. In at least one aspect, the probiotic of the kit can additionally or alternatively include one or more of: *Bifidobacterium infantis, Lactobacillus plantarum, Lactobacillus delbrueckii, Lactobacillus bulgaricus, Lactococcus cremoris*, or *Enterococcus faecium*. In at least one aspect, the probiotic of the kit can additionally or alternatively include one or more of *Roseburia hominis, Akkermansia mucimphila*, or *Faecalibacterium prausnitzii*. In at least one aspect, the probiotic of the kit can additionally or alternatively include one or more bacterium of the Lachnospiraceae family.

In at least one aspect, a kit can include any of the compositions disclosed herein and any of the probiotics disclosed herein.

Methods of the present disclosure can also include administering a composition to a mammalian subject, preferably in a manner that delivers or disposes the composition, or the one or more bacteriophage thereof, into the gut or intestinal microbiome of the subject. In at least one aspect of the method, the composition includes a pharmaceutically-acceptable carrier and greater than or equal to $1 \times 10^4$ (or $1 \times 10^5$, etc.) plaque forming units per milliliter (PFU/mL) or PFU per milligram (PFU/mg), of one or more bacteriophage, preferably having a tropism that comprises one or more obesogenic, inflammatory, and/or other bacterium associated with an intestinal microbiome of a mammal. In at least one aspect, the foregoing method can additionally include administering a probiotic to the mammalian subject, preferably in a manner that delivers or disposes the probiotic into the gut or intestinal microbiome of the subject. In at least one aspect, the administered probiotic comprises a mixture of bacteria comprising *Bifidobacterium* sp. and *Lactobacillus* sp. In at least one aspect, the administered probiotic comprises one or more of: *Lactobacillus rhamnosus, Lactobacillus reuteri, Bacteroides fragilis, Bifidobacterium breve, Bifidobacterium longum, Bifidobacterium pseudocatenulatum*. In at least one aspect, the administered probiotic can additionally or alternatively include one or more of: *Lactobacillus acidophilus, Lactobacillus brevis, Lactobacillus casei, Lactobacillus salivarius, Lactobacillus lactis, Bifidobacterium bifidum*, or *Bifidobacterium lactis*. In at least one aspect, the administered probiotic can additionally or alternatively include one or more of: *Bifidobacterium infantis, Lactobacillus plantarum, Lactobacillus delbrueckii, Lactobacillus bulgaricus, Lactococcus cremoris*, or *Enterococcus faecium*.

In at least one aspect of the disclosed methods, administering the composition to the mammalian subject reduces a concentration of one or more obesogenic bacterium in the intestinal microbiome of the mammalian subject. In at least one aspect, administering the composition to the mammalian subject additionally or alternatively promotes or induces weight loss in the mammalian subject. In at least one aspect, administering the composition to the mammalian subject reduces inflammation, supports metabolic health, and/or supports a healthy balance/diversity within the gut microbiome of the mammalian subject.

In at least one aspect of the disclosed methods, the composition is co-administered with any one of the disclosed probiotics.

This summary is provided to introduce a selection of concepts in a simplified form that are further described below in the detailed description. This summary is not intended to identify key features or essential features of the claimed subject matter, nor is it intended to be used as an indication of the scope of the claimed subject matter.

Additional features and advantages of the disclosure will be set forth in the description which follows, and in part will be obvious from the description, or may be learned by the practice of the disclosure. The features and advantages of the disclosure may be realized and obtained by means of the instruments and combinations particularly pointed out in the appended claims. These and other features of the present disclosure will become more fully apparent from the following description and appended claims or may be learned by the practice of the disclosure as set forth hereinafter.

BRIEF DESCRIPTION OF THE DRAWINGS

In order to describe the manner in which the above recited and other advantages and features of the disclosure can be obtained, a more particular description of the disclosure briefly described above will be rendered by reference to specific embodiments thereof, which are illustrated in the appended drawings. It is appreciated that these drawings depict only typical embodiments of the disclosure and are not therefore to be considered to be limiting of its scope. The disclosure will be described and explained with additional specificity and detail through the use of the accompanying drawings in which:

FIG. 2A illustrates a graphical representation depicting hsCRP results of a cohort of participants whose hsCRP levels were above the healthy range at the start of the study. FIG. 2B illustrates a graphical representation of the hsCRP results for all participants. FIG. 2C illustrates a graphical representation of participants' reduction in body weight. FIG. 2D illustrates a graphical representation of the participants' reduction in body mass index (BMI). FIG. 2E illustrates a graphical representation of the participants' increase in high-density lipoprotein (HDL) cholesterol. FIG. 2F illustrates a graphical representation of the participants' fasting blood glucose levels. FIGS. 2G and 2H illustrate graphical representations of participants' alanine aminotransferase (ALT) and aspartate aminotransferase (AST) levels, respectively. FIG. 2I illustrates a graphical representation of the participants' triglyceride levels.

FIG. 3 illustrates a table illustrating the tropism of select bacteriophages of the present disclosure.

DETAILED DESCRIPTION

Figure 1:
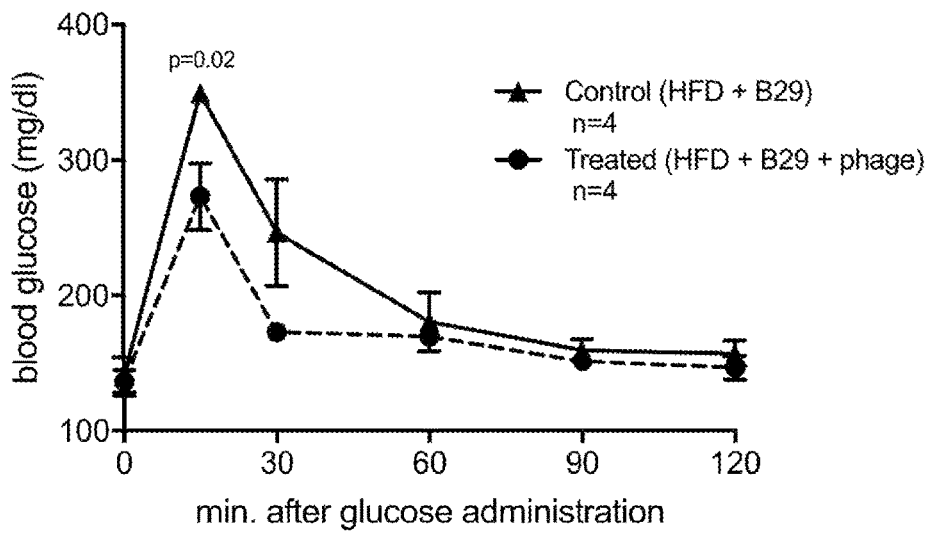
FIG. 1 is a graphical representation showing improved glucose tolerance in mice with intestinal microbiotas colonized with *Enterobacter cloacae* strain B29 treated for 8 weeks with bacteriophages as compared to control mice with intestinal microbiotas colonized with *Enterobacter cloacae* strain B29 but not treated with bacteriophages. All mice were on a high fat diet throughout the experiment.

Before describing various embodiments of the present disclosure in detail, it is to be understood that unless otherwise indicated, numbers expressing quantities, constituents, or other measurements used in the specification and claims are to be understood as being modified by the term "about," as that term is defined herein. Accordingly, unless indicated to the contrary, the numerical parameters set forth in the specification and attached claims are approximations that may vary depending upon the desired properties sought to be obtained by the subject matter presented herein. At the very least, and not as an attempt to limit the application of the doctrine of equivalents to the scope of the claims, each numerical parameter should at least be construed in light of the number of reported significant digits and by applying ordinary rounding techniques. Notwithstanding that the numerical ranges and parameters setting forth the broad scope of the subject matter presented herein are approximations, the numerical values set forth in the specific examples are reported as precisely as possible. Any numerical values, however, inherently contain certain errors necessarily resulting from the standard deviation found in their respective testing measurements.

It should also be appreciated that any headings and subheadings used herein are for organizational purposes only and are not meant to be used to limit the scope of the description or the claims.

PCT Application No. PCT/US18/22419 filed Mar. 14, 2018, is incorporated by reference herein in its entirety.

Overview of Disclosed Embodiments

It has only recently become appreciated that dysbiosis of the gut microbiota fosters obesity. There is an on-going effort to identify causative bacterial strains within the microbiota of obese individuals. Evidence suggests that these "obesogenic bacteria" are not only associated with obesity but may also be associated with increased low-level inflammation throughout the body, which may impair insulin responsiveness and/or contribute to a variety of inflammation-associated conditions. Indeed, the obesogenic action of certain bacteria may originate, at least in part, in the inflammation-inducing activity of these bacteria. Obesogenic bacteria may also increase the host's ability to harvest and store energy from food.

The gram-negative opportunistic pathogen *Enterobacter cloacae* strain B29, isolated from the gut of an obese human, is the first human gut bacterium shown to cause obesity when transplanted into germ-free mice. Research using Koch's postulates showed that *Enterobacter cloacae* strain B29 causes obesity and chronic inflammation in its host. Another potentially obesogenic bacterium, *Clostridium ramosum*, is elevated in the gut microbiota of obese humans and also has an increased prevalence within the gut microbiota of women with type-2 diabetes. When transplanted into germ-free mice, *C. ramosum* has been shown to induce obesity.

It has been postulated that altering the composition or concentration of certain bacteria in the gut microbiome can support weight management, weight loss and/or contribute to the prevention and/or treatment of metabolic disorders. U.S. Publication 2011/0123501, for example, proposes strategies for modulating, in particular reducing, the amount of proteobacteria in the gut with compositions comprising an agent that reduces the amount of proteobacteria in the gut. The '501 publication focuses primarily on antibiotics for reducing the proteobacterial population in the gut and food grade bacteria, in particular probiotics, for further affecting the gut microbiome. In addition to the probiotic, the '501 publication also broadly lists prebiotics, yeasts, phytochemicals, and bacterial phages as potential components in the composition.

The '501 publication does not, however, disclose any actual bacteriophage or even which species of the nearly 50 enterobacteria genera listed in the specification are or should be targeted by said bacteriophages to reduce their prevalence in the gut and thereby afford some beneficial effect to its host. Indeed, there is no evidence in the publication that the group ever possessed, tested, classified, confirmed, formulated, and/or administered a single phage. Rather, the disclosure, with respect to phage-based compositions, is akin to a wish-list, acknowledging that there is a continued need in the art for a composition that comprises phage that can target and kill obesogenic bacteria in the gut.

Moreover, while the addition or introduction of a particular obesogenic bacterium to a host microbiome may cause or contribute to obesity, the inverse is not necessarily true. It is entirely unclear from the '501 publication whether simply reducing the concentration of the obesogenic bacterium within the host microbiome is sufficient to induce weight loss, particularly weight loss commensurate with the weight gain attributable to the introduction or presence of the obesogenic bacterium in the host's gut microbiome. While weight gain has been correlated with the introduction of *Enterobacter cloacae* strain B29, for example, into the mammalian gut microbiome, to the knowledge of the inventors, there is no objective data showing that the targeted removal of *Enterobacter cloacae* strain B29 or any other single obesogenic bacterium from the host microbiome causes or induces weight loss and/or promotes lasting weight loss.

Research has also shown rapid weight regain after diet-induced weight loss, due to persistence of what is assumed to be obesogenic bacteria within the hosts' gut microbiota. Accordingly, there is reason to believe that the composition of the gut microbiota is resistant to change, and while dieting can lead to temporary weight loss, it is likely occurring without restoring the gut microbiota to a balanced, "healthy" composition or diversity. As such, the presence or increased concentration of obesogenic bacteria within the host gut microbiome may cause an alteration in the membership or concentration of other microbes and thereby create an altered microbiota or altered gut environment that is conducive to weight gain or other undesirable effects.

The adverse or negative effects of so-called "bad" bacteria in the gut microbiome is often contributed to their production of endotoxins. Without being to any particular theory, gram negative bacteria are generally known to have or produce such endotoxins (e.g., as part of their cell wall). Bad bacteria in the gut microbiome may be gram negative, endotoxin-producing bacteria. Many so-called "good" bacteria in the gut microbiome are also gram negative. In a healthy gut, the endotoxin-laden good bacteria are not generally harmful; they are mostly commensal in nature. However, in situations of a so-called "leaky gut" (increased intestinal permeability, where bacteria and toxins are able to "leak" through the intestinal wall) or other similar pathologies, even good bacteria (or, more specifically, the endotoxins of or produced by said good bacteria) can cause (additional) inflammation or otherwise exacerbate certain condition.

To address these and other problems in the art, the compositions, kits, and methods of the present disclosure target and reduce the amount or concentration of obesogenic, inflammatory, and/or other bacteria within the intestinal microbiome. By reducing or eliminating these bacteria, ecological space is created for beneficial (or at least non-obesogenic) bacteria to thrive, which can improve the balance of the gut microbiota. The inventors of the present disclosure found that individuals experienced weight loss following administration of bacteriophage cocktails targeted to obesogenic bacteria. By targeting obesogenic bacteria using the disclosed compositions, individuals receive other unexpected physiological benefits beyond weight loss, such as reduced inflammation, supported metabolic health (e.g., increased high-density lipoprotein (HDL), decreased triglyceride levels, decreased fasting blood glucose levels, decreased alanine aminotransferase (ALT) levels, and decreased aspartate aminotransferase (AST) levels), and/or support of a healthy balance/diversity within the gut microbiome. Accordingly, compositions of the present disclosure can be useful and/or effective to reduce inflammation, support metabolic health (e.g., increased high-density lipoprotein (HDL), decrease triglyceride levels, decrease fasting blood glucose levels, decrease alanine aminotransferase (ALT) levels, decrease aspartate aminotransferase (AST) levels), and/or support a healthy balance/diversity within the gut microbiome.

Compositions of the present disclosure can provide a targeted therapy for conditions caused by or resulting, at least in part from, particular bacteria found in the mammalian gut microbiome. For example, compositions disclosed herein include one or more bacteriophages that specifically target and kill obesogenic, inflammatory, and/or other bacterium while not infecting human cells or killing non-target bacteria. Unlike broad-spectrum antibiotics, which indiscriminately kill, each of the one or more bacteriophages within the disclosed compositions has a narrow tropism, killing only a specific subset of bacterial genera and/or species. This beneficially allows the reduction and/or eradication of a targeted subset of bacteria—the obesogenic bacteria—while leaving unharmed other non-obesogenic bacteria within the microbiome.

Treatment with the inventive phage composition has been shown to lead to weight loss, improved glucose tolerance, and a reduction in inflammatory markers in human and/or mouse subjects. While not intending to be bound to any theory, bacteriophages can be (highly) specific to their target (or tropic) bacterial hosts. Accordingly, the down-stream effects of phage treatment (likely) result, directly and/or indirectly, from the reduction in target bacteria in the (gut microbiome) of the subject.

Treatment with the inventive phage composition to human subjects has also been shown to have the following beneficial effects: (i) increased energy and/or better stamina; (ii) greater regularity and ease of bowel movements with softer stools and/or reduced/less constipation; (iii) reduced appetite/food cravings; (iv) improved muscle tone and/or reduced inches around arms and/or waist; (v) improved complexion/skin and/or reduced acne; (vi) improved mood and/or better mental awareness; (vii) improved concentration and/or mental focus; (viii) reduced feeling of depression; (ix) reduced, alleviated, and/or elimination of chronic stomach aches; and/or (x) an overall positive impact. Accordingly, compositions of the present disclosure can be used to treat a variety of conditions, ranging from obesity (or over-weight), stomach pain, constipation, and food cravings, to low-energy or stamina, impaired mental focus, depression/mood disorders, and ache/skin conditions. The foregoing outcomes are also attributed to the reduction in target bacteria in the (gut microbiome) of the subject.

Various kits are additionally disclosed that include (i) a composition of the present disclosure, having one or more bacteriophage for reducing or eliminating one or more obesogenic, inflammatory, and/or other bacterium and (ii) a probiotic and/or prebiotic. Traditionally, probiotic foods and pills have proven unlikely and/or ineffective to produce lasting changes because bacterial species that are already stably established in the ecosystem of the gut microbiome have a strong advantage over newly introduced species. By combining the disclosed bacteria-killing composition with a probiotic, the kits disclosed herein provide an improved way of incorporating beneficial, probiotic bacteria into the gut microbiome while also beneficially preventing or resisting the targeted bacteria from returning to previously held positions and/or concentrations within the intestinal microbiome.

Compositions and Kits for Affecting the Intestinal Microbiome of a Mammal

Embodiments of the present disclosure include compositions that, when administered to a mammalian subject in a manner that delivers or disposes the composition, or the one or more bacteriophage thereof, into the gut or intestinal microbiome of the subject, affect the number or concentration of microbes constituting the subject's intestinal microbiome. In some exemplary embodiments, the subject is a mammal, preferably a human. A mammal includes any mammal, such as by way of non-limiting example, cattle, pigs, sheep, goats, horses, camels, buffalo, cats, dogs, rats, mice, and humans.

Each of the disclosed compositions includes a pharmaceutically-acceptable carrier in addition to one or more bacteriophages having a (narrow) tropism for one or more obesogenic, inflammatory, and/or other bacterium. As used herein, the term "tropism" is understood as the host range, number, and/or type of prokaryotes, preferably bacteria, that a given bacteriophage may successfully infect. A successful infection comprises the ability of a phage to bind and enter a host cell, replicate its genome and package the replicated genomes into capsids to form virion particles, and exit the host cell, preferably via a lytic event.

Some bacteriophages are understood to have broad microbial tropism, being capable of successfully infecting bacteria from different phylogenetic orders and/or greater than 10, preferably greater than 8, or more preferably greater than 6 different genera and/or species of bacteria within the same phylogenetic order, while other bacteriophages have a narrower tropism, being capable of successfully infecting, preferably, bacteria from the same phylogenetic order, more preferably only select genera and/or species of bacteria. In some instances, a bacteriophage may have a narrow tropism for bacteria derived from a single genera or bacterial species or strain. A bacteriophage having a "narrow tropism" is understood to be capable of successfully infecting less than or equal to 6, preferably less than or equal to 5, or more preferably less than or equal to 4, still more preferably less than or equal to 3, still more preferably less than or equal to 2, most preferably a single bacterial genera and/or species or strain, particularly within the *Enterobacter, Escherichia, Serratia, Klebsiella, Citrobacter, Kluyvera*, and *Yokenella* genera. In some embodiments, the tropism of the bacteriophage is limited to genera within the Enterobacteriaceae family.

In some embodiments, the composition includes a single bacteriophage having a narrow tropism. Such compositions can be useful to target and reduce the concentration of a single, or narrow range of, bacterial genera and/or species or strain in the mammalian gut. In at least one aspect, the bacteriophage is tropic for at least one *Enterobacter* sp., preferably *Enterobacter cloacae*, more preferably *Enterobacter cloacae* strain B29. The bacteriophage can include, for example, any one of Optium-18, Optium-38, Optium-125, Optium-126, and/or Optium-712.

In another aspect, the bacteriophage is tropic for at least one *Klebsiella* sp., preferably *Klebsiella pneumoniae*. The bacteriophage can include, for example, any one of Optium-12, Optium-79, and/or Optium-817.

In another aspect, the bacteriophage is tropic for at least one *Serratia* sp., preferably *Serratia marcescens*. The bacteriophage can include, for example, any one of Optium-148, Optium-155, Optium-162, and/or Optium-169.

In another aspect, the bacteriophage is tropic for at least one *Escherichia* sp., preferably *Escherichia coli*. The bacteriophage can include, for example, any one of Optium-212, Optium-719, and/or Optium-819.

In another aspect, the composition includes a plurality of bacteriophages. The plurality of bacteriophages can each have a narrow tropism and/or the plurality can have a collectively narrow tropism. In at least one aspect, the narrow tropism can be a similar or the same tropism. For instance, the plurality of bacteriophages can each target the same single, or narrow range of, bacterial genera and/or species or strain. Illustratively, the plurality of bacteriophages can be tropic for the same *Enterobacter* sp., preferably *Enterobacter cloacae*, more preferably *Enterobacter cloacae* strain B29. The bacteriophage can include, for example, any two or more of Optium-18, Optium-38, Optium-125, Optium-126, and Optium-712. Such compositions can be useful to target and reduce the concentration of, for example, the same *Enterobacter* sp. in the mammalian gut, preferably while not exhibiting cross reactivity with other bacterial genera and/or species or strain in the mammalian gut. Moreover, such compositions can be useful to target and kill the single, or narrow range of, bacterial genera and/or species or strain in the mammalian gut before the bacterium has time to adapt and/or develop resistance to any one or more of the plurality of bacteriophages.

In another aspect, the plurality of bacteriophages can be tropic for the same *Klebsiella* sp., preferably *Klebsiella pneumoniae*. The bacteriophages can include, for example, any two or more of Optium-12, Optium-79, and/or Optium-817.

In another aspect, the plurality of bacteriophages can be tropic for the same *Serratia* sp., preferably *Serratia marcescens*. The bacteriophages can include, for example, any two or more of Optium-148, Optium-155, Optium-162, and/or Optium-169.

In another aspect, the plurality of bacteriophages can be tropic for the same *Escherichia* sp., preferably *Escherichia coli*. The bacteriophages can include, for example, any two or more of Optium-212, Optium-719, and/or Optium-819.

In another aspect, the plurality of bacteriophages can each have narrow and different tropisms. For instance, the plurality of bacteriophages can each target a different single, or narrow range of, bacterial genera and/or species or strain. Such compositions can be useful to target and reduce the concentration of, for example, a plurality of bacterial genera and/or species or strain in the mammalian gut, preferably while not exhibiting cross reactivity with other bacterial genera and/or species or strain in the mammalian gut. Illustratively, the plurality of bacteriophages can each be tropic for a different single, or narrow range of, bacterial genera and/or species or strain and, collectively, be tropic for at least two bacterial genera and/or species or strain, preferably selected from *Enterobacter* sp., *Escherichia* sp., *Serratia* sp., and/or *Klebsiella* sp., more preferably selected from *Enterobacter cloacae*, preferably *Enterobacter cloacae* strain B29, *Escherichia coli*, *Serratia marcescens*, and/or *Klebsiella pneumoniae*.

Illustratively, the composition can include one or more bacteriophage selected from each of two or more groups of bacteriophage, the groups comprising (1) bacteriophage having tropism for the same *Enterobacter* sp., preferably *Enterobacter cloacae*, more preferably *Enterobacter cloacae* strain B29 and most preferably selected from any one or more of Optium-18, Optium-38, Optium-125, Optium-126, and Optium-712, (2) bacteriophage having tropism for the same *Klebsiella* sp., preferably *Klebsiella pneumoniae*, more preferably selected from any one or more of Optium-12, Optium-79, and/or Optium-817, (3) bacteriophage having tropism for the same *Serratia* sp., preferably *Serratia marcescens*, more preferably selected any one or more of Optium-148, Optium-155, Optium-162, and/or Optium-169, (4) bacteriophage having tropism for the same *Escherichia* sp., preferably *Escherichia coli*, more preferably selected from any one or more of Optium-212, Optium-719, and/or Optium-819. In some embodiments, the composition can include two or more bacteriophages selected from each of two or more of the above groups of bacteriophages. In some embodiments, the composition can include three or more bacteriophage selected from each of two or more the above groups of bacteriophages. Such compositions can be useful to target and kill the target bacterial genera and/or species or strain from each of the two or more groups in the mammalian gut before the bacteria have time to adapt and/or develop resistance to any one or more of the plurality of bacteriophages.

Illustratively, the composition can include one or more bacteriophage selected from each of three or more the above groups of bacteriophages. In some embodiments, the composition can include two or more bacteriophage selected from each of three or more the above groups of bacteriophages. In some embodiments, the composition can include three or more bacteriophage selected from each of three or more the above groups of bacteriophages. Such compositions can be useful to target and kill the target bacterial genera and/or species or strain from each of the three or more groups in the mammalian gut before the bacteria has time to adapt and/or develop resistance to any one or more of the plurality of bacteriophages.

Illustratively, the composition can include one or more bacteriophage selected from each of the four above groups of bacteriophages. In some embodiments, the composition can include two or more bacteriophage selected from each of the four above groups of bacteriophages. In some embodiments, the composition can include three or more bacteriophage selected from each of the four above groups of bacteriophages. Such compositions can be useful to target and kill the target bacterial genera and/or species or strain from each of the four above groups, in the mammalian gut, before the bacteria has time to adapt and/or develop resistance to any one or more of the plurality of bacteriophages.

In some embodiments, the bacteriophage is one or more of Optium-12, Optium-18, Optium-38, Optium-79, Optium-125, Optium-126, Optium-148, Optium-155, Optium-162, Optium-169, Optium-212, Optium-712, Optium-719, Optium-712 and/or Optium-819. In one exemplary embodiment, a composition includes each of bacteriophages Optium-12, Optium-18, Optium-38, Optium-79, Optium- 125, Optium-126, Optium-148, Optium-155, Optium-162, Optium-169, Optium-212, Optium-712, Optium-719, Optium-712 and/or Optium-819 that collectively have a narrow tropism for *Enterobacter cloacae, Escherichia coli, Serratia marcescens,* and/or *Klebsiella pneumoniae.*

In another aspect, the bacteriophage is tropic for at least one of *Enterobacter* sp., *Escherichia* sp., *Serratia* sp., *Klebsiella* sp., *Citrobacter* sp., *Kluyvera* sp., and/or *Yokenella* sp., preferably at least one of *Enterobacter cloacae, Escherichia coli, Serratia marcescens, Klebsiella pneumoniae, Enterobacter aerogenes, Kluyvera ascorbata, Citrobacter freundii,* and/or *Yokenella regensburgei.*

It should be appreciated that the bacterium *Enterobacter aerogenes* has recently been re-classified as *Klebsiella aerogenes,* and for the purposes of this disclosure, the bacterial species *Enterobacter aerogenes* is synonymous with *Klebsiella aerogenes.*

In some embodiments, the bacteriophages is one or more of Optium-12, Optium-17, Optium-18, Optium-24, Optium-27, Optium-34, Optium-35, Optium-38, Optium-46, Optium-67, Optium-79, Optium-82, Optium-86, Optium-88, Optium-113, Optium-116, Optium-117, Optium-118, Optium-121, Optium-125, Optium-126, Optium-148, Optium-155, Optium-162, Optium-169, Optium-212, Optium-219, Optium-225, Optium-304, Optium-356, Optium-417, Optium-502, Optium-531, Optium-574, Optium-688, Optium-712, Optium-716, Optium-719, Optium-747, Optium-812, Optium-817, Optium-819, Optium-835, and/or Optium-971 that collectively have a narrow tropism for *Enterobacter cloacae, Escherichia coli, Serratia marcescens, Klebsiella pneumoniae, Enterobacter aerogenes, Kluyvera ascorbata, Citrobacter freundii,* and/or *Yokenella regensburgei.*

For example, a composition of the present disclosure can include a plurality of bacteriophages that collectively have a narrow tropism for two or more obesogenic, inflammatory, and/or other bacteria. A first bacteriophage or set of bacteriophages can have a tropism for *Enterobacter* sp., preferably *Enterobacter cloacae,* more preferably *Enterobacter cloacae* strain B29. The first bacteriophage can be selected from the group consisting of Optium-18, Optium-38, Optium-125, Optium-126, and Optium-712. In some embodiments, the first bacteriophage is included within a first set of bacteriophages that includes at least one other bacteriophage selected from the group consisting of Optium-18, Optium-38, Optium-125, Optium-126, and Optium-712. In some embodiments, the first set of bacteriophages includes each of Optium-18, Optium-38, Optium-125, Optium-126, and Optium-712.

Alternatively, the first bacteriophage and/or first set of bacteriophages can have a tropism for *Escherichia* sp., preferably *Escherichia coli.* The first bacteriophage can be selected from the group consisting of Optium-212, Optium-719, and Optium-819. In some embodiments, the first bacteriophage is included within a first set of bacteriophages that includes at least one other bacteriophage selected from the group consisting of Optium-212, Optium-719, and Optium-819. In some embodiments, the first set of bacteriophages includes each of Optium-212, Optium-719, and Optium-819.

Alternatively, the first bacteriophage and/or first set of bacteriophages can have a tropism for *Serratia* sp., *Serratia marcescens.* The first bacteriophage can be selected from the group consisting of Optium-148, Optium-155, Optium-162, and Optium-169. In some embodiments, the first bacteriophage is included within a first set of bacteriophages that includes at least one other bacteriophage selected from the group consisting of Optium-148, Optium-155, Optium-162, and Optium-169. In some embodiments, the first set of bacteriophages includes each of Optium-148, Optium-155, Optium-162, and Optium-169.

Alternatively, the first bacteriophage and/or first set of bacteriophages can have a tropism for *Klebsiella* sp., preferably *Klebsiella pneumoniae.* The first bacteriophage can be selected from the group consisting of Optium-12, Optium-79, and Optium-817. In some embodiments, the first bacteriophage is included within a first set of bacteriophages that includes at least one other bacteriophage selected from the group consisting of Optium-12, Optium-79, and Optium-817. In some embodiments, the first set of bacteriophages includes each of Optium-12, Optium-79, and Optium-817.

The first bacteriophage and/or first set of bacteriophages can be included in a composition having a second bacteriophage and/or second set of bacteriophages having a tropism for at least one of *Enterobacter* sp., *Escherichia* sp., *Serratia* sp., and *Klebsiella* sp., preferably at least one of *Enterobacter cloacae, Escherichia coli, Serratia marcescens,* and *Klebsiella pneumoniae.*

In embodiments where the second bacteriophage and/or second set of bacteriophages is tropic for *Enterobacter* sp., preferably *Enterobacter cloacae,* the second bacteriophage can be any of Optium-18, Optium-38, Optium-125, Optium-126, and Optium-712. The second bacteriophage can additionally be included with a second set of bacteriophages that includes at least one other bacteriophage selected from Optium-18, Optium-38, Optium-125, Optium-126, and Optium-712. In some embodiments, the second set of bacteriophages includes each of Optium-18, Optium-38, Optium-125, Optium-126, and Optium-712.

In embodiments where the second bacteriophage and/or second set of bacteriophages is tropic for *Escherichia* sp., preferably *Escherichia coli,* the second bacteriophage can be any of Optium-212, Optium-719, and Optium-819. The second bacteriophage can additionally be included with a second set of bacteriophages that includes at least one other bacteriophage selected from Optium-212, Optium-719, and Optium-819. In some embodiments, the second set of bacteriophages includes each of Optium-212, Optium-719, and Optium-819.

In embodiments where the second bacteriophage and/or second set of bacteriophages is tropic for *Serratia* sp., preferably *Serratia marcescens,* the second bacteriophage can be any of Optium-148, Optium-155, Optium-162, and Optium-169. The second bacteriophage can additionally be included with a second set of bacteriophages that includes at least one other bacteriophage selected from Optium-148, Optium-155, Optium-162, and Optium-169. In some embodiments, the second set of bacteriophages includes each of Optium-148, Optium-155, Optium-162, and Optium-169.

In embodiments where the second bacteriophage and/or second set of bacteriophages is tropic for *Klebsiella* sp., preferably *Klebsiella pneumoniae,* the second bacteriophage can be any of Optium-12, Optium-79, and Optium-817. The second bacteriophage can additionally be included with a second set of bacteriophages that includes at least one other bacteriophage selected from Optium-12, Optium-79, and Optium-817. In some embodiments, the second set of bacteriophages includes each of Optium-12, Optium-79, and Optium-817.

It should be appreciated that upon selecting a second bacteriophage and/or second set of bacteriophages, the composition can additionally include a third and/or fourth bacteriophage or sets of bacteriophages. Each of the third and fourth bacteriophages or sets of bacteriophages can be selected from the remaining sets of bacteriophages tropic for *Enterobacter* sp., *Escherichia*, sp., *Serratia* sp., or *Klebsiella* sp., preferably *E. cloacae, E. coli, S. marcescens,* or *K. pneumoniae.*

In addition to the foregoing, the composition can include additional sets of bacteriophages having a tropism for additional obesogenic, inflammatory, and/or other bacteria. For example, the composition can include one or more bacteriophages tropic for *Enterobacter aerogenes,* including any (or all) of Optium-27, Optium-35, Optium-82, Optium-688 Optium-747, and Optium-971. Additionally, or alternatively, the composition can include one or more bacteriophages tropic for *Kluyvera* sp., preferably *Kluyvera ascorbata,* including any (or all) of Optium-67, Optium-121, Optium-502, and Optium-531. Additionally, or alternatively, the composition can include one or more bacteriophages tropic for *Citrobacter* sp., preferably *Citrobacter freundii,* including any (or all) of Optium-24, Optium-117, Optium-219, Optium-225 Optium-574, and Optium-716. Additionally, or alternatively, the composition can include one or more bacteriophages tropic for *Yokenella* sp., preferably *Yokenella regensburgei,* including any (or all) of Optium-46, Optium-116, Optium-304, Optium-356, Optium-812, and Optium-835.

In some embodiments, the composition includes only one bacteriophage or a plurality of bacteriophages selected from Optium-24, Optium-27, Optium-35, Optium-46, Optium-67, Optium-82, Optium-116, Optium-117, Optium-121, Optium-219, Optium-225, Optium-304, Optium-356, Optium-502, Optium-531, Optium-574, Optium-688, Optium-716, Optium-747, Optium-812, Optium-835, and Optium-971.

The number and type of phage included within the composition may vary according to the application and obesogenic, inflammatory, and/or other bacteria to be targeted. In some embodiments, the composition includes at least two, preferably 3-5 bacteriophages having a tropism for the same target bacteria. Having more than one bacteriophage specific for a given bacterium can beneficially increase the effectiveness of the composition. The tropism for at least some of the bacteriophages disclosed herein is illustrated in FIG. 3. In some instances, an illustration of tropism such as that shown in FIG. 3 can be helpful in selecting the number and type of phages to include in a composition having a single bacteriophage or cocktail of bacteriophages. For example, a minimum (or smaller number) of phages can be selected based on their overlapping tropism such that at least two, preferably 3-5 phages, are tropic for each of the target bacteria.

In a preferred embodiment, the bacteriophages are additionally selected for those with greater genetic diversity from each other and/or for the mode of attachment or infection. Targeting the same bacterium with a plurality of genetically diverse phages and/or phages having different modes of attachment or infection can beneficially reduce the likelihood of escape mutants within the bacterial populations.

It should be appreciated that the bacteriophages included in the composition can be selected de novo in addition to and/or complementary with the foregoing and can be selected for a narrow tropism against any target obesogenic, inflammatory, and/or other bacteria. Such identification and selection can be undertaken, for example, using the disclosed processes for making the disclosed compositions.

Alternatively, or in addition, the bacteriophage can be classified or typed as, or have a classification (or type) selected from the group consisting of: Myoviridae, preferably (i) T4-like, more preferably subcluster G, I, or a new or unknown subcluster type, or (ii) RV5-like, more preferably subcluster C or a new or unknown subcluster type; Podoviridae, preferably T7-like, more preferably subcluster B or a new or unknown subcluster type; Siphoviridae, preferably (i) S01-like, more preferably subcluster A or a new or unknown subcluster type, (ii) 9g-like, more preferably subcluster B or a new or unknown subcluster type, (iii) T1-like, more preferably subcluster B, D, or a new or unknown subcluster type; Jello cluster, preferably subcluster A, B, or a new or unknown subcluster type; FaintSaint cluster; and Phage T1-like. Table 1 (below) illustrates various classifications for 15 separate bacteriophages of the present disclosure. Additional bacteriophages of the present disclosure can be similarly classified.

TABLE 1

Possible Classification of Various Disclosed Bacteriophages

| Bacterial Target | Phage Name | Classification |
| --- | --- | --- |
| *Enterobacter cloacae* | Opt-18 | Myoviridae, T4-like subcluster I |
| | Opt-38 | unknown |
| | Opt-125 | Myoviridae, T4-like subcluster G |
| | Opt-126 | Myoviridae, T4-like |
| | Opt-712 | Podoviridae, T7-like |
| *Escherichia coli* | Opt-212 | Siphoviridae, SO1-like subcluster A |
| | Opt-719 | Siphoviridae, 9g-like subcluster B |
| | Opt-819 | Myoviridae, RV5-like subcluster C |
| *Klebsiella pneumoniae* | Opt-12 | Podoviridae, T7-like subcluster B |
| | Opt-79 | Siphoviridae, T1-like subcluster B |
| | Opt-817 | Siphoviridae, T1-like subcluster D |
| *Serratia marcescens* | Opt-148 | Jello Cluster, subcluster A |
| | Opt-155 | FaintSaint cluster |
| | Opt-162 | Jello Cluster, subcluster B |
| | Opt-169 | Phage T1-like |

Testing shows that each of the bacteriophages listed in Table 1, above (see column 2—Phage Name) and further, each of the bacteriophages listed in FIG. 3 (see column 2—Phage Name) have, exhibit, and/or possess (i) the ability to successfully specifically target, infect, and kill (e.g., lyse) their corresponding bacterial host target(s) (see column 1—Bacterial Target) and, in some instances, (ii) a narrow tropism for said target(s) (with little or no significant cross reactivity with other host targets listed in Table 1, FIG. 3, and/or common to the mammalian and/or human gut (microbiome). See FIG. 3. Where a first bacteriophage exhibits a narrow tropism for a single host bacterium, said first bacteriophage can be useful for highly specific targeting and killing of said single bacterium, whether used (e.g., administered) alone or in combination with one or more additional bacteriophage. The one or more additional bacteriophage can have (i) the same or (ii) a different narrow tropism (e.g., a specific infectivity for the same, single bacterial host or a different single bacterial host). Alternatively, the one or more additional bacteriophage can have tropism broader than the tropism of said first bacteriophage (e.g., a specific infectivity for a range of bacterial hosts, which may or may not include the bacterial host of the first bacteriophage).

Where the first bacteriophage exhibits broad tropism for a plurality of host bacterial hosts, said first bacteriophage can be useful for broad targeting and killing of said plurality host bacterial hosts, whether used (e.g., administered) alone or in combination with one or more additional bacteriophage. The one or more additional bacteriophage can have (i) the same or (ii) a different broad tropism (e.g., a specific infectivity for the same plurality of bacterial hosts or other than the plurality of bacterial hosts). Alternatively, the one or more additional bacteriophage can have narrow tropism for a single or narrower range of bacterial hosts. In each case, each of the bacteriophage listed in FIG. 3, for example, can be useful (e.g., as a component of a composition for administration to a mammalian, preferably human, subject) alone or in combination with any one or more of the other bacteriophage listed in FIG. 3, for example.

In some embodiments, a targeted therapeutic can be developed, prescribed and/or administered to treat a specific combination of (potentially harmful or detrimental) bacteria in the gut microbiome of the subject. Alternatively, a composition that comprises a standard or universal cocktail (or mixture) of phage, which, collectively, target and kill any of a variety of (potentially harmful or detrimental) bacteria that may be present in the gut microbiome of the subject, can be developed, prescribed and/or administered.

The tropism for each bacteriophage listed in Table 3 was determined using a lytic activity assay, as described, for example, in Example 4 below, where the respective bacteriophage was combined with a culture of the specific target microbe. Aliquots of the culture over time were plated to determine the (degree of) presence or absence of the bacterium over time. A reduced bacterial titer corresponded with the bacteriophage being tropic for and killing the bacterium. For example, as shown in FIG. 4A-4I, each of Optium-125, Optium-417, Optium-18, Optium-118, Optium-86, Optium-712, Optium-113, Optium-34, and Optium-38, respectively, was analyzed using a lytic activity assay, and as shown in FIGS. 4A-4I, the phages were able to infect and lyse *Enterobacter cloacae*, specifically strain B29. This demonstrates both the phages' lytic capacity and tropism for the given target bacterium. It should be appreciated that the lytic activity assay is one method for characterizing the lytic activity and/or tropism for identified phages, but other methods and assays exist and are known in the art that can be used in addition to or alternatively from the plaque-based assay. For example, a plaque assay or spot assay could be used.

The bacteriophages incorporated into compositions of the present disclosure preferably do not have genes encoding bacterial toxins that may negatively affect a human, such as, for example, cholerae toxin, botulinum toxin, and diphtheria toxin. Additionally, the bacteriophage is preferably devoid of any gene encoding a bacterial virulence factor or phage integrase genes. This can beneficially prevent the bacteriophage from delivering a virulence factor to its host bacterium, which could then cause a non-pathogen or opportunistic pathogen to become virulent.

The bacteriophages of various embodiments may include mutant or recombinant strains of an isolated bacteriophage capable of infecting and lysing the obesogenic, inflammatory, and/or other bacterium. The mutant of various embodiments can be prepared, for example, by exposing an isolated bacteriophage to a mutagenic agent such as a chemical mutagen or electromagnetic radiation. Recombinant bacteriophage strains of various embodiments can be prepared by inserting a polynucleotide into the genome of the isolated bacteriophage strain, where the polynucleotide encodes for an antibacterial protein or therapeutic protein. Examples of antibacterial and therapeutic proteins are disclosed in PCT Application Publication No. WO 2018/174810 and WO 2018/030323, the disclosures of which are incorporated in its entirety by reference herein.

As discussed above, the compositions of the present disclosure include bacteriophages that, when administered to a mammal, preferably a human, decrease the number or concentration of obesogenic, inflammatory, and/or other bacteria within the intestinal microbiome of the mammal. The compositions disclosed herein can be included within a kit that additionally includes a probiotic and/or prebiotic. Alone, a probiotic may not be as effective or have as much of a beneficial effect when the bacteria within the probiotic have to compete with native bacteria in the gut. However, when coupled with and co-administered with the compositions disclosed herein, the disclosed probiotics can beneficially improve and/or stabilize the gut microbiome and provide a healthier and often more diverse microbiome. This may be due, at least in part, to the bacteriophages within the composition clearing niches within the gut previously held by the targeted bacteria. The probiotic microbes can then colonize the newly clearly niches throughout the gut and thereby provide a twofold benefit: preventing the recolonization of obesogenic, inflammatory, and/or other bacteria by occupying the newly cleared niches and providing the host with beneficial nutrients and/or metabolites.

In one embodiment, the probiotic includes a plurality of bacteria selected from *Bifidobacterium* sp. and *Lactobacillus* sp. For example, a probiotic of the present disclosure can include any (or all) of *Lactobacillus acidophilus, Lactobacillus brevis, Lactobacillus* casei, *Lactobacillus salivarius, Lactobacillus lactis, Bifidobacterium bifidum*, and/or *Bifidobacterium lactis*.

In addition to, or alternatively from, the foregoing bacterial strains, the priobiotic can include any (or all) of *Lactobacillus rhamnosus, Lactobacillus reuteri, Bacteroides fragilis, Bifidobacterium breve, Bifidobacterium longum*, and/or *Bifidobacterium pseudocatenulatum*. In some embodiments, the priobiotic can additionally include one of, a plurality of, or all of: *Bifidobacterium infantis, Lactobacillus plantarum, Lactobacillus delbrueckii, Lactobacillus bulgaricus, Lactococcus cremoris*, and/or *Enterococcus faecium*.

In addition to, or alternatively from, the foregoing bacterial strains, the priobiotic can include any (or all) of *Roseburia hominis, Akkermansia muciniphila*, or *Faecalibacterium prausnitzii*. Additionally, or alternatively, the probiotic can include one or more bacterium of the Lachnospiraceae family.

Formulation and Dosage of Compositions

As provided above, each of the disclosed compositions includes a pharmaceutically-acceptable carrier in addition to one or more bacteriophages having a narrow tropism for one or more obesogenic, inflammatory, and/or other bacterium. As used herein the term "pharmaceutically acceptable" means a biologically compatible formulation, gaseous, liquid or solid, or mixture thereof, that is suitable for one or more routes of administration, in vivo delivery, or contact. A formulation is compatible in that it does not destroy activity of an active ingredient therein (e.g., the bacteriophage or bacteriophage cocktail) or induce adverse side effects that outweigh any prophylactic or therapeutic effect or benefit.

It should be appreciated that the disclosed compositions may contain one or more (pharmaceutically-acceptable) carriers or excipients. Pharmaceutically acceptable carriers and excipients (or the pharmaceutical acceptability thereof) are determined in part by the particular composition being administered, as well as by the particular method used to administer the composition. Accordingly, there exists a wide variety of suitable formulations of pharmaceutical compositions (see, e.g., Remington's Pharmaceutical Sciences, incorporated herein by reference).

Suitable excipients may be or include carrier molecules and can include antioxidants such as ascorbic acid; chelating agents such as EDTA; carbohydrates such as dextrin, hydroxyalkylcellulose, hydroxyalkylmethylcellulose, and stearic acid; liquids such as oils, water, saline, glycerol and ethanol; wetting or emulsifying agents; pH buffering substances; and the like. Liposomes are also included within the definition of pharmaceutically acceptable excipients.

Additional or alternative examples of carriers include silicon dioxide (silica, silica gel), carbohydrates or carbohydrate polymers (polysaccharides), cyclodextrins, starches, degraded starches (starch hydrolysates), chemically or physically modified starches, modified celluloses, gum arabic, ghatti gum, tragacanth, karaya, carrageenan, guar gum, locust bean gum, alginates, pectin, inulin or xanthan gum, or hydrolysates of maltodextrins. In various embodiments, the bacteriophage can be dispersed throughout the carrier. In various embodiments, the pharmaceutically acceptable excipient or carrier can be suitable for oral consumption.

The compositions described herein may be formulated in any form suitable for the intended method of administration. When intended for oral use, for example, tablets, troches, lozenges, aqueous or oil suspensions, non-aqueous solutions, dispersible powders or granules (including micronized particles or nanoparticles), emulsions, hard or soft capsules, syrups, or elixirs may be prepared. Orally consumable products can also include a semi-solid food, solid food, a semi-solid or solid spoonable food, confectionary, drink, or dairy product. The dairy product of various embodiments is ice cream, milk, milk powder, yogurt, kefir, or quark. Compositions intended for oral use may be prepared according to any method known to the art for the manufacture of pharmaceutical compositions, and such compositions may contain one or more agents including sweetening agents, flavoring agents, coloring agents, and preserving agents to provide a palatable preparation.

Pharmaceutically acceptable excipients particularly suitable for use in conjunction with tablets include, for example, inert diluents, such as celluloses, calcium or sodium carbonate, lactose, calcium or sodium phosphate; disintegrating agents, such as cross-linked povidone, maize starch, or alginic acid; binding agents, such as povidone, starch, gelatin, or acacia; and lubricating agents, such as magnesium stearate, stearic acid, or talc.

Tablets may be uncoated or may be coated by known techniques including microencapsulation to delay disintegration and adsorption in the gastrointestinal tract and thereby provide a sustained action over a longer period. For example, a time delay material such as glyceryl monostearate or glyceryl distearate alone or with a wax may be employed.

Formulations for oral use may be also presented as hard gelatin capsules where the active ingredient is mixed with an inert solid diluent, for example celluloses, lactose, calcium phosphate or kaolin, or as soft gelatin capsules wherein the active ingredient is mixed with non-aqueous or oil medium, such as glycerin, propylene glycol, polyethylene glycol, peanut oil, liquid paraffin or olive oil.

In another embodiment, pharmaceutical compositions may be formulated as suspensions comprising a compound of the embodiments in admixture with at least one pharmaceutically acceptable excipient suitable for the manufacture of a suspension.

In yet another embodiment, pharmaceutical compositions may be formulated as dispersible powders and granules suitable for preparation of a suspension by the addition of suitable excipients.

Excipients suitable for use in connection with suspensions include suspending agents, such as sodium carboxymethylcellulose, methylcellulose, hydroxypropyl methylcellulose, sodium alginate, polyvinylpyrrolidone, gum tragacanth, gum acacia, dispersing, or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethyleneoxycethanol), a condensation product of ethylene oxide with a partial ester derived from a fatty acid and a hexitol anhydride (e.g., polyoxyethylene sorbitan monooleate); polysaccharides and polysaccharide-like compounds (e.g., dextran sulfate); glycoaminoglycans and glycosaminoglycan-like compounds (e.g., hyaluronic acid); and thickening agents, such as carbomer, beeswax, hard paraffin, or cetyl alcohol. The suspensions may also contain one or more preservatives such as acetic acid, methyl and/or n-propyl p-hydroxy-benzoate; one or more coloring agents; one or more flavoring agents; and one or more sweetening agents such as sucrose or saccharin.

The pharmaceutical compositions may also be in the form of oil-in water emulsions. The oily phase may be a vegetable oil, such as olive oil or arachis oil, a mineral oil, such as liquid paraffin, or a mixture of these. Suitable emulsifying agents include naturally-occurring gums, such as gum acacia and gum tragacanth; naturally occurring phosphatides, such as soybean lecithin, esters, or partial esters derived from fatty acids; hexitol anhydrides, such as sorbitan monooleate; and condensation products of these partial esters with ethylene oxide, such as polyoxyethylene sorbitan monooleate. The emulsion may also contain sweetening and flavoring agents. Syrups and elixirs may be formulated with sweetening agents, such as glycerol, sorbitol, or sucrose. Such formulations may also contain a demulcent, a preservative, a flavoring, or a coloring agent.

Cosolvents and adjuvants may be added to the formulation. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters. Adjuvants include, for example, surfactants such as, soya lecithin and oleic acid; sorbitan esters such as sorbitan trioleate; and polyvinylpyrrolidone.

It should be appreciated that the compositions and/or formulations disclosed herein contain a total amount of one or more bacteriophages (collectively or individually) sufficient to achieve the intended effect (e.g., reduce the number or concentration of obesogenic, inflammatory, and/or other bacteria in the intestinal microbiome of the subject).

The compositions may, for convenience, be prepared or provided as a unit dosage form and can be packaged in unit dosage forms for ease of administration and uniformity of dosage. A "unit dosage form" as used herein refers to a physically discrete unit suited as unitary dosages for the subject to be treated. Each unit containing a predetermined quantity of the one or more bacteriophage optionally in association with a pharmaceutically-acceptable carrier (e.g., excipient, diluent, vehicle or filling agent) which, when administered in one or more doses, is calculated to produce the desired effect (e.g., reduce the number or concentration of obesogenic, inflammatory, and/or other bacteria in the intestinal microbiome of the subject). Unit dosage forms can contain a daily dose or unit, daily sub-dose, or an appropriate fraction thereof, of an administered compound. Unit dosage forms also include, for example, capsules, troches, cachets, lozenges, tablets, ampules and vials, which may include a composition in a freeze-dried or lyophilized state. A sterile liquid carrier, for example, can be added prior to administration or delivery in vivo. Unit dosage forms additionally include, for example, ampules and vials with liquid compositions disposed therein. The individual unit dosage forms can be included in multi-dose kits or containers.

A dosage (or administration) of the composition can one or more doses. A dose of the composition can include, for example, greater than or equal to $1 \times 10^4$ PFU/mL or PFU/mg of composition of one or more bacteriophage, in accordance with one or more aspects or embodiments of the present disclosure. Alternative doses can include greater than or equal to $1 \times 10^5$, $1 \times 10^6$, $1 \times 10^7$, $1 \times 10^8$, $1 \times 10^9$, or $1 \times 10^{10}$ PFU/mL or PFU/mg. Suitable dosage size or amounts can range from 1 µL to 500 mL or more (e.g., of fluid or semi-solid composition), 1 µg to 5000 mg or more (e.g., of solid or semi-solid composition), or other amount as known in the art.

The disclosed compositions can be administered in accordance with the methods at any frequency as a single bolus or multiple dose e.g., one, two, three, four, five, or more times hourly, daily, or weekly or for as long as appropriate. Exemplary frequencies are typically from 1-3 times, 2-times or once, daily; for example, once per day for 30 days or indefinitely. Timing of administration can be dictated by the desired physiological characteristic to be affected, such as decreasing or inducing weight loss, decreasing inflammation, etc. The skilled artisan will appreciate the factors that may influence the dosage, frequency, and timing required to provide an amount sufficient or effective for providing the desired effect or benefit. Dosage and administration can be adjusted to provide sufficient levels of the one or more bacteriophage (collectively or individually) or to maintain the desired effect.

In at least one embodiment, the composition can be administered or received as part of a treatment protocol. The treatment protocol can include a first treatment period (or phase). The first treatment phase can include a first dosage of the composition, administered or received in accordance with a first dosage schedule. The first dosage schedule can be, for example, a daily dosage schedule or any other suitable dosage schedule (e.g., twice daily, every other day, once weekly, twice weekly, etc.). The first dosage can include any suitable dose (amount) disclosed herein. In at least one embodiment, the first dose (amount) of the first dosage in the first treatment phase can be or include a (relatively high) initial treatment dose (e.g., greater than or equal to $1 \times 10^6$, $1 \times 10^7$, $1 \times 10^8$, $1 \times 10^9$, or $1 \times 10^{10}$ PFU/mL or PFU/mg. In some embodiments, the first dosage phase (or schedule thereof) can be or last for any suitable amount of time (e.g., greater than or equal to 1 week, 2 weeks, 3 weeks, 4 weeks, 1 month, 2 months, 3 months, 6 months, 9 months 1 year, etc.).

In some embodiments, the treatment protocol can include a second treatment period (or phase). The second treatment phase can include a second dosage of the composition, administered or received in accordance with a second dosage schedule. The second dosage schedule can be, for example, a weekly dosage schedule or any other suitable dosage schedule (e.g., daily, every other day, twice weekly, etc.). The second dosage can include any suitable dose (amount) disclosed herein. In at least one embodiment, the second treatment phase can include a (lower) maintenance treatment dose (e.g., greater than or equal to $1 \times 10^4$, $1 \times 10^5$, $1 \times 10^6$, $1 \times 10^7$, or $1 \times 10^8$ PFU/mL or PFU/mg. Illustratively, the second dosage can include a lower concentration of phage that the first dosage. Alternatively, or in addition, the second treatment phase can include a less frequent dosage schedule than the first treatment phase. In some embodiments, the second dosage phase (or schedule thereof) can be or last for any suitable amount of time (e.g., greater than or equal to 3 months, 6 months, 9 months, 1 year, 2 years, 3 years, etc., or indefinitely).

In some embodiments, a composition containing one or more bacteriophages is co-administered with a probiotic and/or prebiotic.

As used herein, "co-administration" means concurrently or administering one substance followed by beginning the administration of a second substance within 24 hours, 20 hours, 16 hours, 12 hours, 8 hours, 4 hours, 1 hour, 30 minutes, 15 minutes, 5 minutes, 1 minute, a range bounded by any two of the aforementioned numbers, and/or about any of the aforementioned numbers. In some embodiments, co-administration is concurrent administration.

Processes and Methods for Making and Administering Compositions

Embodiments of the present disclosure additionally include processes for making the compositions disclosed herein and methods for administering said compositions to decrease the number or concentration of obesogenic, inflammatory, and/or other bacteria in the intestinal microbiome of a mammal, preferably a human.

An exemplary process for preparing the bacteriophage component of compositions disclosed herein, includes isolating the bacteriophage from an environmental source and characterizing the bacteriophage. An exemplary, detailed process is provided in Example 3 below.

In general, "characterizing" the bacteriophage consists of measuring its lytic activity to ensure that the bacteriophage is a lytic phage and not a lysogenic phage, measuring the host range to ensure the phage has a narrow tropism that includes a desired bacterial target, passing it through mice to ensure that the bacteriophage survives conditions of the mammalian gastrointestinal tract, and sequencing the bacteriophage genome to ensure that the phage is not harboring any bacterial toxin or virulence factor or integrase gene, which may indicate that the phage can be lysogenic. During the characterizing process, any bacteriophage that fails any one criterion is excluded from further consideration.

In some embodiments, genomic sequencing of the bacteriophage is performed to determine how closely related each of the various phages are, particularly when those phages are tropic for the same bacterium. This additional, sometimes optional step, can beneficially allow for the selection and combination of phages that are as unrelated to each other as possible and to decrease the likelihood that the targeted bacteria can develop resistance against the selected phages. Thus, after identifying and characterizing a first bacteriophage, additional phages specific for each additional putative obesogenic, inflammatory, and/or other bacterium can be included that are each validated as lytic, having a narrow and specific tropism, able to survive conditions in the mammalian GI tract, and unlikely to promote bacterial escape mutants resistant to the cocktail of phages.

Following isolation and characterization, the selected bacteriophage is prepared in any manner to be incorporated as a component of a food stuff, feed additive, or liquid additive and can be in various forms such as, for example, a liquid state or a dried state including as a powder. In other examples, the bacteriophage is dried by air drying method, natural drying method, a spray drying method, a freeze-drying method, or the like. The preparation of the bacteriophage strain can also serve to enhance the properties of the composition including stability. The term "foodstuff" is understood to be any substance or product which in the processed, partially processed, or unprocessed state are intended to be, or reasonably expected to be, ingested by humans. "Foodstuff" can also include drinks, chewing gum, and any substance—including water—intentionally added to the foodstuff during its manufacture, preparation or treatment. The term "feed" is understood to cover all forms of animal food. Foodstuffs can also be used as feeds.

In various embodiments, the bacteriophage is prepared in any manner to be incorporated as a component of a nutritional supplement to promote or support weight management and control, support metabolic health, and/or support a healthy balance in the gut microbiota, and can be in various forms such as, for example, a liquid state or a dried state including a powder. The term "nutritional supplement" is understood to cover substances or substance compositions which are intended as agents having properties to support or promote health, but not to treat, diagnose, prevent, or cure any disease.

As discussed above, the compositions disclosed herein can be administered alone or co-administered with a probiotic. The administration dosage and schedule can be determined based on the desired effect and as known in the art.

Abbreviated List of Defined Terms

To assist in understanding the scope and content of the foregoing and forthcoming written description and appended claims, a select few terms are defined directly below. Unless defined otherwise, all technical and scientific terms used herein have the same meaning as commonly understood by one of ordinary skill in the art to which the present disclosure pertains.

The terms "bacteriophage" or "phage," as used herein, includes any prokaryotic virus, preferably lytic viruses, that infect and kill bacteria. "Bacteriophage" and "phage" are used interchangeably and can include naturally-occurring and recombinant bacteriophages, unless otherwise indicated. A "naturally-occurring" bacteriophage is a phage isolated from a natural or human-made environment that has not been modified by genetic engineering. A "recombinant bacteriophage" is a phage that comprises a genome that has been genetically modified by insertion of a heterologous nucleic acid sequence into the genome or by removal of a nucleic acid sequence from the genome. The genome of a naturally-occurring phage may be modified by recombinant DNA technology to introduce a heterologous nucleic acid sequence into the genome at a defined site. Additionally, or alternatively, the genome of a naturally-occurring phage may be modified by recombinant DNA technology to remove nucleic acid sequences that, for example, encode bacterial virulence factors (e.g., toxins). A further description of bacteriophages can be found in U.S. Pat. No. 9,617,522, the entirety of which is incorporated by reference herein.

The term "co-administration" and similar terms refer to concurrent, sequential, and/or combined administration of two or more components. For instance, two components can be co-administered by administering each component in a separate dosage concurrently, simultaneously, or sequentially (e.g., distinct administrations separated by a period of time). The period of time can be very short (e.g., substantially immediately following a first administration) or it may be longer (e.g., 10-60 seconds later, 1-60 minutes later, 1-24 hours later, 1-7 days later, or any value or range of values therebetween). Concurrent or simultaneous administration can include overlapping administration timeframes for the two or more components or administration of a combination product comprising a mixture of the two or more components.

As used herein, the term "cocktail," "bacteriophage cocktail, "phage cocktail," or similar is intended to be understood as a composition that includes two or more bacteriophages. The composition may have a proportional or disproportional number or concentration of phages, and the phages comprising the cocktail may have overlapping or non-overlapping tropisms. The cocktail can be in a dry form or suspended in a pharmaceutically-acceptable carrier.

The term "gut," as used herein, is synonymous with "digestive tract," "gastrointestinal tract," or similar and is intended to include the system of modified epithelial cells, mucus, and associated environment and secreted factors spanning between the mammalian mouth and anus, including the intervening organs (e.g., stomach, small intestine, and large intestine).

The term "microbiome" may refer generally to the collective genomes of the microbiota or to the microorganisms themselves and may be used synonymously with the term microbiota.

The term "microbiota" generally refers to the population, collection, and/or totality of microbes in a defined environment, habitat, or ecological community, and typically includes a plurality of genera, species, or strains of commensal, symbiotic, beneficial, and/or opportunistic pathogenic microorganisms (e.g., bacteria, archaea, fungae, protists, and/or viruses), and typically including their genetic elements (genomes). For example, as used herein, the term "microbiota" or "microbiome" is generally made with reference to the population of microbes inhabiting the intestinal tract of a mammal (i.e. the intestinal microbiome).

The term "narrow host range," as used herein, particularly with respect to the tropism of a given bacteriophage, The term "obesogenic bacterium," "obesogenic bacteria," or similar term is intended to encompass those bacteria whose presence, concentration, or imbalance within the intestinal microbiome of a mammalian subject, preferably humans, correlate with, promote, or induce weight gain in the mammalian subject and/or whose removal or reduction within the intestinal microbiome of a mammalian subject, preferably humans, correlate with, promote, or induce weight loss in the mammalian subject. For example, a bacterium within the intestinal microbiome of a mammalian subject may be understood to be an obesogenic bacterium if when targeted by a specific bacteriophage (e.g., via administration of a tropic phage or phage cocktail), a concomitant reduction in the concentration of the bacterium correlates with, promotes, or induces weight loss in the mammalian subject (e.g., over time).

The term "inflammatory bacterium," "inflammatory bacteria," or similar term is intended to encompass those bacteria whose presence, concentration, or imbalance within the intestinal microbiome of a mammalian subject, preferably humans, correlates with, promotes, or induces inflammation, preferably low-level, systemic inflammation in the mammalian subject and/or whose removal or reduction within the intestinal microbiome of a mammalian subject, preferably humans, correlates with, promotes, or induces a decrease in such inflammation and/or inflammatory markers in the mammalian subject. For example, a bacterium within the intestinal microbiome of a mammalian subject may be understood to be an inflammatory bacterium if, when targeted by a specific bacteriophage (e.g., via administration of a narrowly tropic phage or phage cocktail), a concomitant reduction in the concentration of the bacterium correlates with, promotes, or induces a decrease in (low-level systemic) inflammation and/or inflammatory markers in the mammalian subject (e.g., over time).

The term "prebiotic" generally refers to a component (e.g., an energy source or food, food ingredient, dietary supplement, etc.) that when consumed by a mammalian subject stimulates the growth, diversity, or activity of at least a subset of microbes within the subject's microbiome. In some instances, the prebiotic can be selected to include a preferred food source for one or more bacteria within the subject's intestinal microbiome and/or within a co-administered probiotic to encourage the growth or activity of that population of microbes.

The term "probiotic" generally refers to one or more live microbes associated with neutral or beneficial effects in the mammalian gastrointestinal tract. An exemplary probiotic can include one or more of *Lactobacillus* sp., *Bifidobacterium* sp., *Saccharomyces* sp., and/or a component (e.g., a food, food ingredient, dietary supplement, etc.) that includes the same. Typically, when consumed, a probiotic can assist in maintaining or restoring beneficial levels, diversity, or activity, of the microbiome.

The terms "sequence identity" or "identity" refers to a specified percentage of residues in two nucleic acid or amino acid sequences that are identical when aligned for maximum correspondence over a specified comparison window, as measured by sequence comparison algorithms or by visual inspection. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity.

The term "subject," as used herein, is synonymous with the terms "patient," "individual," and similar terms, and generally refers to individual or organism of any mammalian species, (1) preferably including humans, whether or not under the care of a healthcare provider (e.g., a physician, nurse, or medical assistant or volunteer), and (ii) non-human mammals, whether or not under the care of a veterinarian or other veterinary professional, assistant, or volunteer, such as, but not limited to, dogs, cats, horses, cattle, rodents, or other domesticated or wild mammal.

Sequence Listing Table

For convenience, Table 2 (below) includes a list of each sequenced bacteriophage with its corresponding SEQ ID NO.

TABLE 2

SEQ ID NO Listing

| SEQ ID NO. | Optium Phage Name |
|---|---|
| SEQ ID NO. 1 | Optium-12 |
| SEQ ID NO. 2 | Optium-18 |
| SEQ ID NO. 3 | Optium-38 |
| SEQ ID NO. 4 | Optium-79 |
| SEQ ID NO. 5 | Optium-125 |
| SEQ ID NO. 6 | Optium-126 |
| SEQ ID NO. 7 | Optium-148 |
| SEQ ID NO. 8 | Optium-155 |
| SEQ ID NO. 9 | Optium-162 |
| SEQ ID NO. 10 | Optium-169 |
| SEQ ID NO. 11 | Optium-712 |
| SEQ ID NO. 12 | Optium-212 |
| SEQ ID NO. 13 | Optium-719 |
| SEQ ID NO. 14 | Optium-817 |
| SEQ ID NO. 15 | Optium-819 |
| SEQ ID NO. 16 | Optium-34 |
| SEQ ID NO. 17 | Optium-113 |
| SEQ ID NO. 18 | Optium-118 |
| SEQ ID NO. 19 | Optium-417 |

EXAMPLES

Example 1

FIG. 1 is a graphical representation showing improved oral glucose tolerance in mice with intestinal microbiotas colonized with *Enterobacter cloacae* strain B29 treated with bacteriophages as compared to control mice with intestinal microbiotas colonized with *Enterobacter cloacae* strain B29 but not treated with bacteriophages. As shown in FIG. 1, the phage cocktail inhibits B29-induced glucose intolerance. Prior to colonization with the human pathogen *E. cloacae* strain B29, mice are treated with oral antibiotics to deplete their native gut microbiota.

During week 1, all mice receive daily doses of B29 by oral gavage and are placed on a high fat diet (60% of total energy from fat, 20% from carbohydrates, and 20% from protein) to induce weigh gain. During week 2, the treatment group (dashed line) receives 7 daily doses of phage cocktail by oral gavage. During weeks 3-8, the treatment group (black line) receives bacteriophages in drinking water. The bacteriophage cocktail included greater than or equal to $1\times10^9$ PFU of Optium-125, Optium-417, Optium-18, Optium-118, Optium-86, Optium-712, Optium-113, Optium-34, and Optium-38.

The oral glucose tolerance test was performed at the end of week 8 by administering a glucose solution by oral gavage and monitoring blood glucose levels at the indicated time points over the next 2 hours. Blood sugar levels are significantly improved in the phage-treated group ($p<0.05$).

Example 2

A four-week test/trial was conducted using 17 individuals (10 male and 7 female) between the ages of 25 and 59 years old taking a single daily dose of a bacteriophage cocktail. The cocktail included greater than or equal to $1\times10^8$ PFU of Optium-12, Optium-18, Optium-38, Optium-79, Optium-125, Optium-126, Optium-212, Optium-712, Optium-719, Optium-712 and Optium-819, having a combined tropism for *Enterobacter cloacae, Escherichia coli,* and *Klebsiella pneumoniae*. Prior to inclusion within the composition, each bacteriophage was isolated at a titer greater than or equal to $1.0\times10^9$ phages.

Blood samples were taken from the participants and tests were performed before and after the four-week period. Blood tests showed statistically significant improvements in the reduction of inflammation, reduction in body weight and Body Mass Index (BMI), and an increase in high-density lipoprotein (HDL) cholesterol.

Figure 2A:
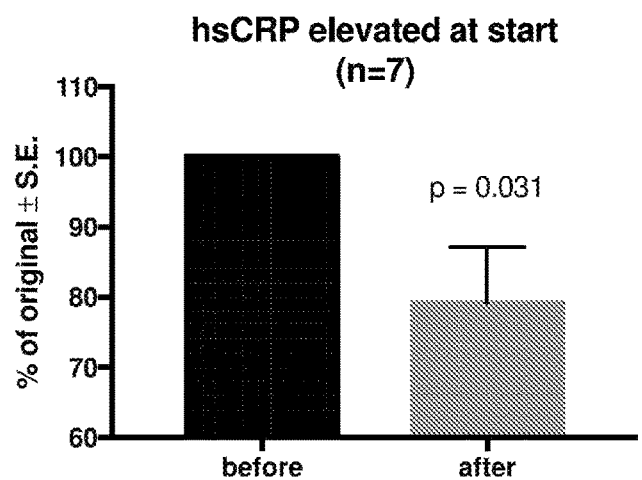
FIGS. 2A-2I illustrate results from a four-week trial of 17 individuals taking a single daily dose of a composition comprising a bacteriophage cocktail co-administered with a probiotic.
Figure 2B:
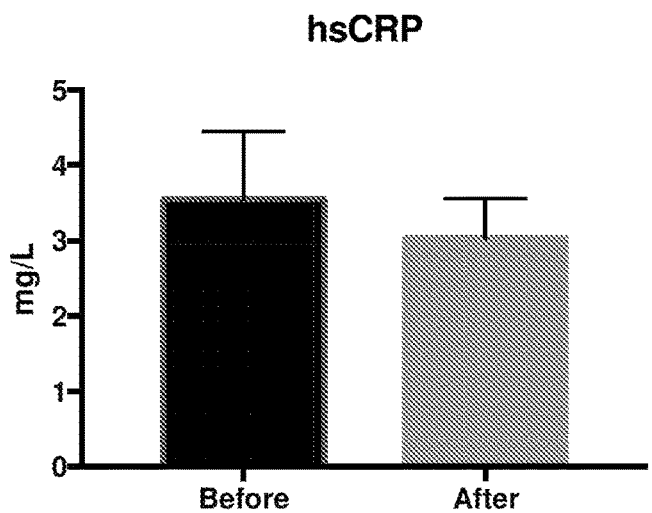
Figure 2C:
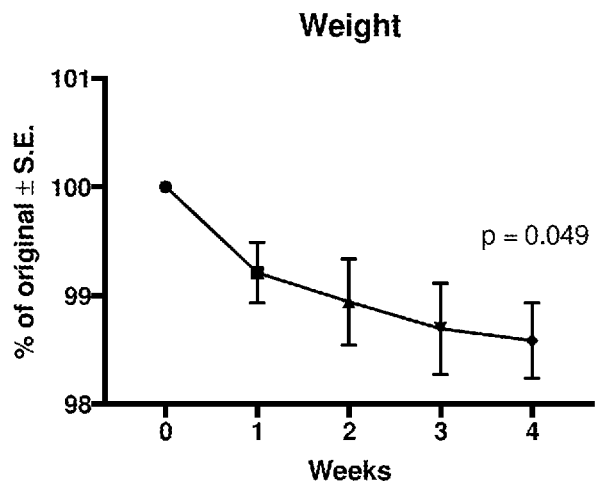
Figure 2D:
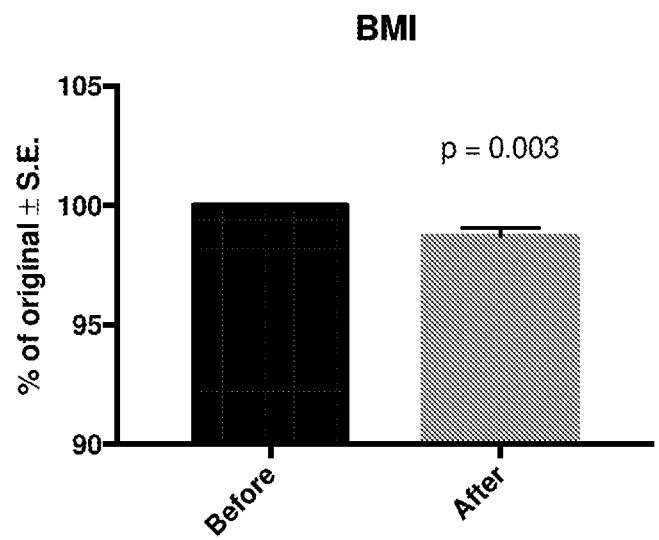
Figure 2E:
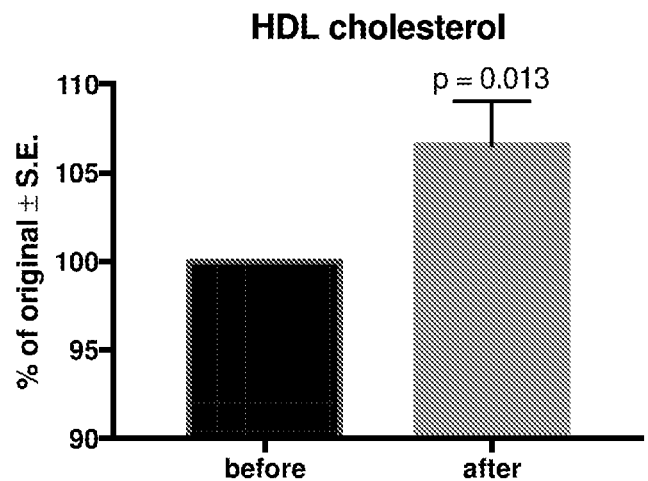
Figure 2F:
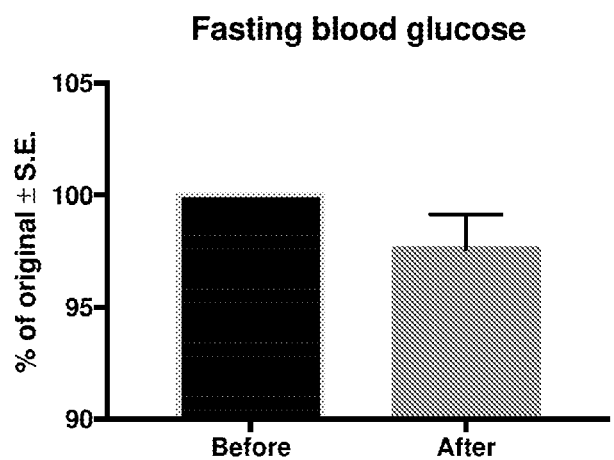
Figure 2G:
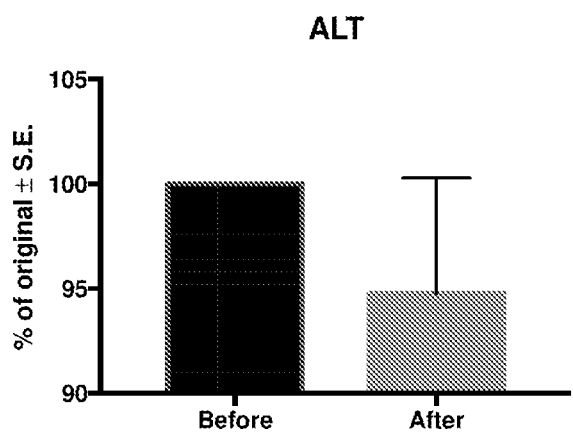
Figure 2H:
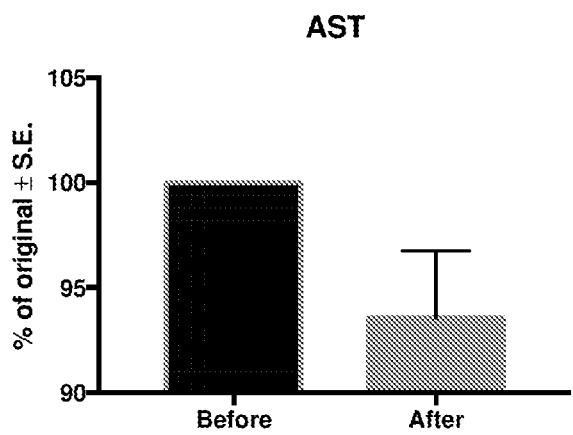
Figure 2I:
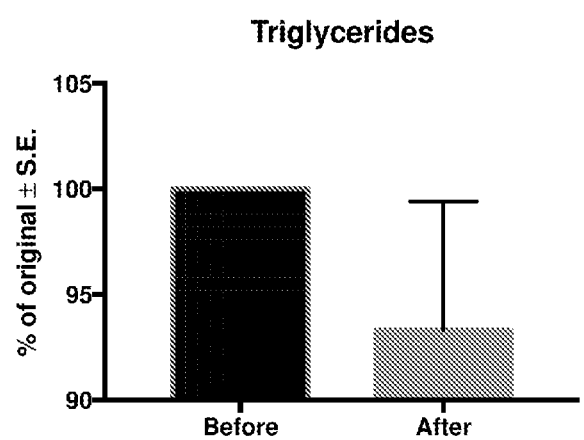
Figure 4A:
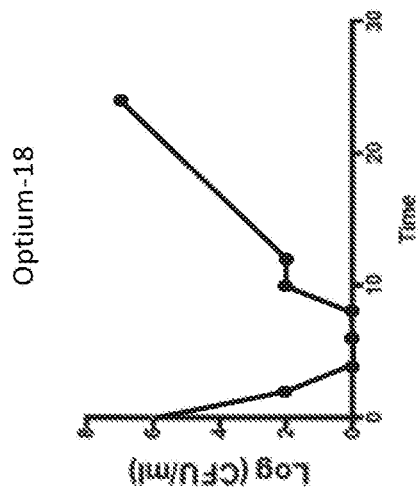
FIG. 4A-4I illustrate graphical representations showing lytic activity and tropism of different bacteriophage strains for *Enterobacter cloacae* strain B29.
Figure 4B:
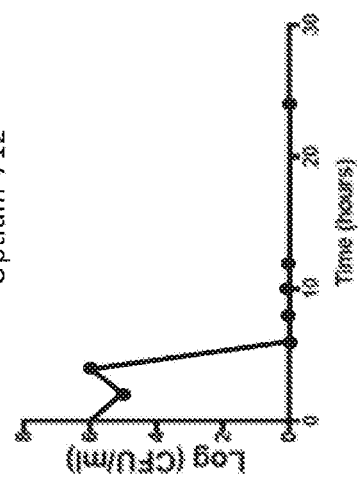
Figure 4C:
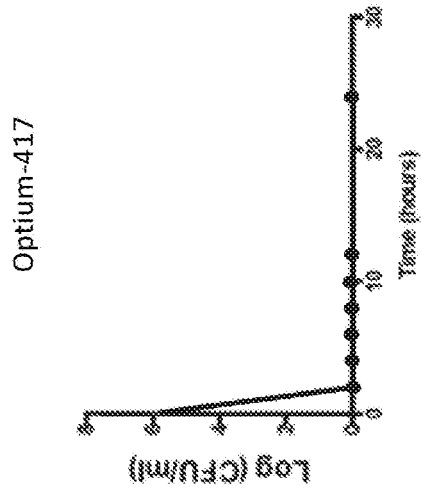
Figure 4D:
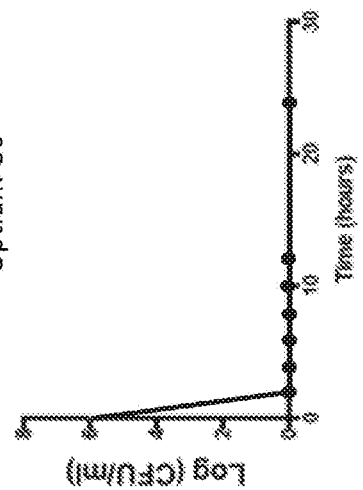
Figure 4E:
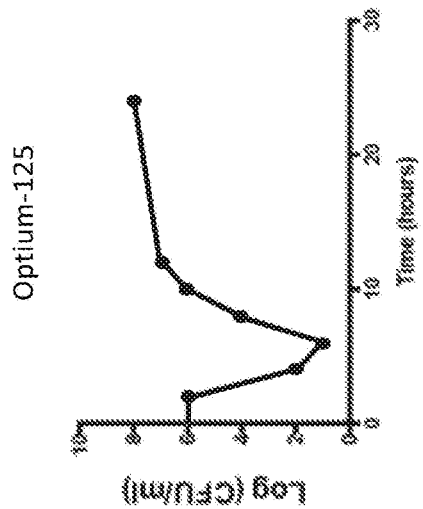
Figure 4F:
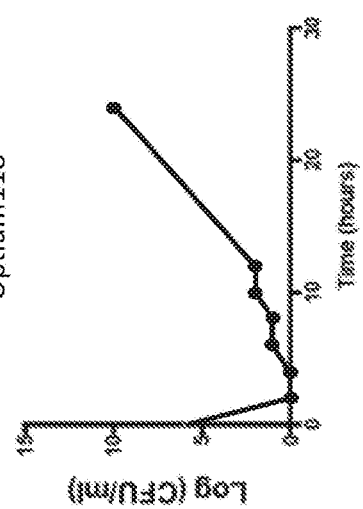
Figure 4I:
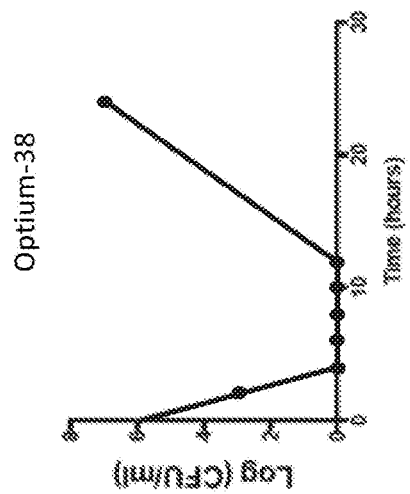
Figure 4H:
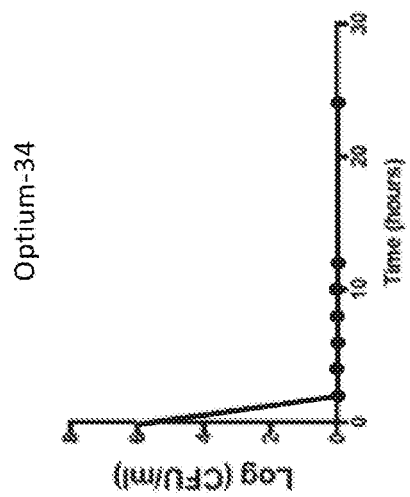
Figure 4G:
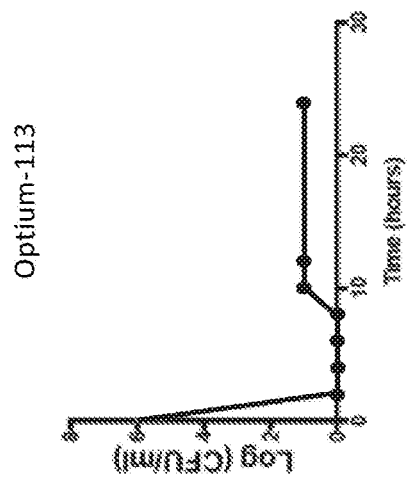

In particular, and as shown in FIG. 2A, there was a 20.8% average reduction in hsCRP in the seven participants whose hsCRP levels were above the normal healthy range before the four-week trial ($p=0.031$). As shown in FIG. 2B, there was a 14.6% average reduction in hsCRP levels across all participants. On average, there was a 1.4% reduction in body weight ($p=0.049$; FIG. 2C), a 1.8% reduction in BMI ($p=0.003$, FIG. 2D), and a 6.5% increase in HDL cholesterol ($p=0.013$, FIG. 2E).

Additionally, as shown in FIGS. 2F-2I, respectively, the trial group demonstrated a 2.4% decrease in fasting blood glucose levels, a 5.3% decrease in alanine aminotransferase (ALT), a 6.4% decrease in aspartate aminotransferase (AST), and a 6.7% decrease in triglycerides.

Daily tracking data recorded by participants further noted the following benefits and impacts associated with administration of the composition. Overall, 76% of participants felt a positive impact from use of the bacteriophage cocktail (24% neutral or negative), 59% reported higher energy and better stamina, 53% reported greater regularity and ease of bowel movements with softer stools (29% noted initial constipation during 1$^{st}$ week), 41% had less appetite, most notably in the afternoons, 29% experienced better muscle tone and/or reduced inches around arms and/or waist, 24% reported strong improvement in complexion/skin and reduced acne, 24% reported improved mood and better mental awareness, 18% were more able to concentrate and focus, 12% reported improvements in self-reported levels of depression (2 of 2 participants with depression noted this positive impact), and 12% experienced alleviation/elimination of chronic stomach aches.

Example 3

An exemplary method for identifying and characterizing bacteriophages for inclusion within a composition for reducing the number or concentration of a bacterium associated with the intestinal microbiome of a mammal includes at least the following method acts.

In general, the method can include: (1) collecting environment sample(s); (2) setting up enrichment culture; (3) isolating phage from the enrichment culture; (4) purifying the phage; (5) phage titer test to high concentration; (6) characterizing the phage (e.g., using electron microscope and genomic DNA isolation and sequencing); (7) performing a restriction enzyme assay; (8) performing a lytic activity assay; and (9) optionally preparing a phage frozen stock.

More particularly, the method can include collect an environment sample from the soil, sewage water, or other environmental source and setting up an enrichment culture. The enrichment culture can include, for example, 25 mL LB broth, 1 mL target bacterium, and 1 mL of the environment sample. The inoculated enrichment culture is then incubated (e.g., at 35° C. for 2 days with aeration). Following incubation, the liquid can be transferred from the flask into a cylindrical or conical tube for centrifugation (e.g., at 8000 RPM for 20 minutes). The supernatant can then be filtered (e.g., using a 0.45 μm filter) into another sterile conical tube and optionally refrigerated.

The phage can subsequently be isolated from the enrichment culture. For example, the filtered enrichment culture can be mixed and serially diluted (e.g., by factors of 10) to a final concentration of $1 \times 10^{-7}$ PFU/mL. An overnight culture of the target bacterium can then be inoculated into each tubes of the dilution series (e.g., using 500 μL of the bacterial culture). The inoculated tubes are then incubated at 35° C. for 40 minutes. Following incubation, each sample is mixed with 5 mL of melted top agar and plated (e.g., onto petri dishes). The plated samples are incubated for 24 h or until plaque formation is visible.

The phages are purified by picking a single plaque with a sterile needle and transferring to sterile media (e.g., LB broth). The inoculated media is mixed, incubated, and phages picked from a resulting plaque are filtered as before prior to serial dilution. An overnight culture of the target bacterium can then be inoculated into each tubes of the dilution series (e.g., using 500 μL of the bacterial culture). The inoculated tubes are then incubated at 35° C. for 40 minutes. Following incubation, each sample is mixed with 5 mL of melted top agar and plated (e.g., onto petri dishes). The plated samples are incubated for 24 h or until plaque formation is visible. This phage purification process may be repeated two or more times.

Following the purification step, the phage titer is determined. This can allow isolation of phage to an adequate high concentration in preparation for further analysis. The phage titer assay can be conducted, for example, by mixing 20 mL LB broth, 0.5 mL of an overnight culture of the target bacterium, and plaque picking from the last phage purification round that had been suspended in 100 uL LB broth. The flask is then incubated at 35° C. for 2 days with medium shaking. Following this incubation period, the sample is centrifuged (e.g., 8000 rpm for 10-15 minutes) and supernatant filtered (e.g., through a 0.45 μm filter). The filtered supernatant can then be used, as above, to generate plaques for determining the concentration of phage within the filtered lysate.

Preferably, the final concentration of the phage lysate is greater than or equal to $1 \times 10^8$ PFU/mL.

The phage can then be characterized. This includes isolating the phage DNA using methods and phage DNA isolation kits, as known in the art. The isolated phage DNA can be sequenced using any method or suitable technology known in the art. If characterized using electron microscopy, 10 μL of phage lysate is combined with 10 μL of tungsten heavy metal solution and placed on an electron microscopy grid and viewed via electron microscopy, as known in the art.

The electron microscopy data can be used to determine phage morphology and structural classification. The sequenced phage DNA can be used to confirm the lack of any bacterial toxin and/or virulence factor and/or integrase gene, and to compare with other phage DNA having a similar tropism for a relative genetic similarity.

Example 4

An exemplary method for determining lytic activity and tropism for identified bacteriophages includes at least the following method acts.

To identify lytic phages, a target bacterium, such as *Enterobacter cloacae* strain B29, was diluted from an overnight culture to a concentration of $1 \times 10^6$ colony-forming units per milliliter (CFU/mL) and inoculated with phage titered to a concentration of $1 \times 10^8$ PFU/mL, giving a multiplicity of infection of 100. One milliliter of sample was removed from the flask, serial diluted, spread over LB-agar plates, and incubated overnight. The number of surviving bacteria was determined by colony count the next day. An additional 1 mL of each sample was removed from respective cultures every 2 hours during the first 12 hours after inoculation then once more at the $24^{th}$ hour after inoculation to detect whether the phage was lytic and whether bacteria develop resistance within the first 24 hours.

The tropism, or target specificity, of each phage was tested by measuring its ability to lyse a range of bacteria, from closely to distantly related bacterial strains. For example, Table 3 illustrates host range testing of 9 bacteriophages that were initially isolated based on their ability to lyse *Enterobacter cloacae* strain B29. Each phage was tested against two other *E. cloacae* strains, namely ATCC 13047 and ATCC 23855, as well as more distantly related *Shigella boydii* (ATCC 9207), *Klebsiella pneumoniae* (ATCC 10031), *Salmonella enterica* Serovar *Typhimurium* LT2, *Escherichia coli* strain 814, *Serratia marcescens*, and *Pseudomonas aeruginosa*.

A spot test was performed by dropping 100 μL of the respective phage solution containing $1 \times 10^9$ PFU/mL onto a lawn of specified-target bacterium and incubating overnight at 37° C. The results are illustrated in Table 3 where a positive indication corresponds to clearing of bacteria in the location where the phages were dropped or "spotted" on the plate. The clearance indicates lysis of the target bacterium and therefore tropism for the same. For example, as shown in Table 3, the different phages display tropism for different bacterial strains, while maintaining tropism for many (or all) of *Enterobacter cloacae* strains tested.

TABLE 3

Spot Test Results

| Species | Spot test | | | | | | | | |
|---|---|---|---|---|---|---|---|---|---|
| | Opt-38 | Opt-125 | Opt-417 | Opt-118 | Opt-34 | Opt-712 | Opt-113 | Opt-18 | Opt-86 |
| E. cloacae B29 | + | + | + | + | + | + | + | + | + |
| E. cloacae ATCC 13047 | + | + | + | + | + | + | + | + | + |
| E. cloacae ATCC 23855 | + | + | + | + | + | + | + | − | − |
| Shigella ATCC 9207 | − | − | − | − | − | − | − | − | − |
| Klebsiella ATCC 10031 | − | − | − | − | − | − | − | − | − |
| Salmonella LT2 | − | − | − | − | − | − | − | − | − |
| E. coli 814 | − | − | − | − | − | − | − | − | − |
| S. marcescnes | − | − | − | − | − | − | − | − | − |
| P. aeruginosa | + | − | − | − | − | − | − | − | − |

The lytic activity of the phages disclosed in Table 3 toward each vulnerable strain of bacteria was further quantified by mixing 100 µL of $1\times10^9$ PFU/mL phage with 500 µL of $1\times10^9$ CFU/mL bacteria and incubating overnight at 37° C. with shaking. The overnight cultures were serially diluted, plated, and plaques were enumerated on the incubated plates to assess each phage's ability to replicate in the host bacteria. Table 4 shows the results of said host range testing of the 9 bacteriophages of Table 3. As shown in Table 4, the different phages display tropisms specific for different strains of *Enterobacter cloacae* (and in one instance *P. aeruginosa*) and are capable of replicating within and lysing the different strains of *Enterobacter cloacae*.

TABLE 4

Infection Efficiency Results

| Species | Efficiency of plating (PFU/ml) | | | | |
|---|---|---|---|---|---|
| | Opt-38 | Opt-125 | Opt-417 | Opt-118 | Opt-34 |
| E. cloacae 629 | $1.77 \times 10^{11}$ | $3.88 \times 10^{11}$ | $2.31 \times 10^{110}$ | $3.31 \times 10^{111}$ | $2.87 \times 10^{8}$ |
| E. cloacae ATCC 13047 | $3.78 \times 10^{10}$ | $2.12 \times 10^{10}$ | $5.55 \times 10^{7}$ | $1.12 \times 10^{113}$ | $4.68 \times 10^{11}$ |
| E. cloacae ATCC 23855 | $1.33 \times 10^{7}$ | $1.44 \times 10^{8}$ | $1.722 \times 10^{14}$ | $8.22 \times 10^{15}$ | $3.33 \times 10^{8}$ |
| Shigella ATCC 9207 | ND | ND | ND | ND | ND |
| Klebsiella ATCC 10031 | ND | ND | ND | ND | ND |
| Salmonella LT2 | ND | ND | ND | ND | ND |
| E. coli 814 | ND | ND | ND | ND | ND |
| S. marcescnes | ND | ND | ND | ND | ND |
| P. aeruginosa | $1.38 \times 10^{7}$ | ND | ND | ND | ND |

| Species | Efficiency of plating (PFU/ml) | | | |
|---|---|---|---|---|
| | Opt-712 | Opt-113 | Opt-18 | Opt-86 |
| E. cloacae 629 | $5.55 \times 10^{7}$ | $6.13 \times 10^{8}$ | $7.46 \times 10^{10}$ | $1.27 \times 10^{11}$ |
| E. cloacae ATCC 13047 | $4.81 \times 10^{8}$ | $1.16 \times 10^{9}$ | $1.68 \times 10^{11}$ | $1.58 \times 10^{13}$ |
| E. cloacae ATCC 23855 | $2.22 \times 10^{5}$ | $2.44 \times 10^{7}$ | ND | $5.01 \times 10^{8}$ |
| Shigella ATCC 9207 | ND | ND | ND | ND |
| Klebsiella ATCC 10031 | ND | ND | ND | ND |
| Salmonella LT2 | ND | ND | ND | ND |
| E. coli 814 | ND | ND | ND | ND |
| S. marcescnes | ND | ND | ND | ND |
| P. aeruginosa | ND | ND | ND | ND |

Example 5

In order for identified phages to be considered for inclusion in the disclosed compositions, we demonstrated that each phage can survive conditions in the mammalian gastrointestinal tract. Phage cocktails were administered to mice by oral gavage, followed by fecal sample collection from which the concentration of phage could be measured. Phages shown by these tests to survive the digestive tract were considered for subsequent development of a therapeutic cocktail.

In particular, for each phage to be tested, male C57 mice (6 weeks old) were obtained and divided into negative control (n=3) and test groups (n=7). The control group were given 0.2 mL sterile Luria broth (LB) via oral gavage once. Test groups were given $1\times10^{10}$ PFU/mL of phage in 0.2 mL of LB broth via oral gavage once. Phages were grown in and purified from host bacteria, and titer determined by standard plaque assay before diluting the phage to the stated concentration in LB. Immediately before the oral gavage, fecal samples were collected from all mice. Fecal samples were also collected from all mice every 6 hours until the 24th hour after gavage. Immediately after collection, each fecal sample was resuspended in phosphate buffered saline and filtered through a 0.45 μm filter to isolate phage. The filtered solution was grown with host bacteria in a standard plaque-forming assay to calculate phage concentration in the fecal sample and thus determine how well the phage had survived the digestive tract. Table 5 shows survivability of the 9 bacteriophages disclosed in Tables 3 and 4 above after passage through the mouse gastrointestinal tract. As shown in Table 1, the different phages are capable of surviving within the digestive tract for an extended period of time.

TABLE 5

Gut Survivability Test Results

| Phages: | Gut Survivalbility Test: Time (hrs) | | | |
|---|---|---|---|---|
| | 0 | 6 | 12 | 24 |
| Opt-38 | − | + | + | + |
| Opt-125 | − | + | + | + |
| Opt-417 | − | + | + | + |
| Opt-118 | − | + | + | + |
| Opt-34 | − | + | + | + |
| Opt-712 | − | + | + | + |
| Opt-113 | − | + | + | + |
| Opt-18 | − | + | + | + |
| Opt-86 | − | + | + | + |

Example 6

In vivo proof-of-principle testing was performed to determine whether phage treatment of gut-associated *Enterobacter cloacae* strain B29 can reduce obesity, inflammation, or other associated metabolic disorders in an animal model. Germ-free mice were inoculated orally with *E. cloacae* strain B29, which was shown to cause inflammation and obesity in the mice. Mice were treated by oral administration of phage tropic for *E. cloacae* strain B29. Phages were tested individually and in combinations of two or more phages, to determine whether inflammation or obesity decreased and to guide formulation of a cocktail to which obesogenic bacteria are unlikely to develop resistance owing at least in part to the multiple phages that are not closely related to each other.

Using broad-spectrum antibiotics to first deplete the native mouse gut microbiota so that *Enterobacter cloacae* strain B29, which does not normally colonize mice, engrafts. Nine bacteriophages with a narrow tropism that includes *Enterobacter cloacae* strain B29 were isolated, verified as lytic, and shown to survive conditions in the mammalian gastrointestinal (GI) tract. Multiple phages that attack their target through different surface receptors were used to decrease the likelihood that target bacteria would evolve resistance to infection.

Figure 5:
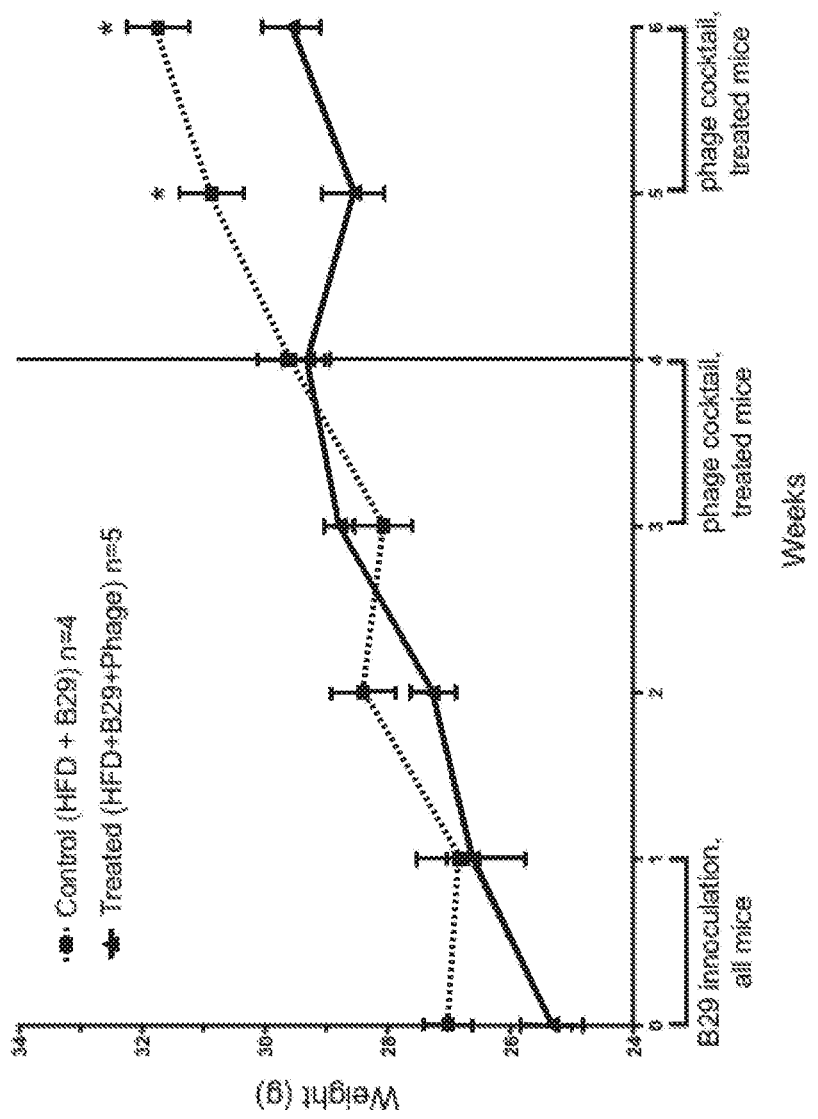
FIG. 5 illustrates a graphical representation showing arrested weight gain in mice with intestinal microbiomes colonized with *Enterobacter cloacae* strain B29 that are treated with *E. cloacae* tropic bacteriophages as compared to untreated control mice with intestinal microbiomes colonized with *Enterobacter cloacae* strain B29.

FIG. 5 is a graphical representation showing arrest of weight gain in mice colonized with *Enterobacter cloacae* strain B29 and subsequently treated with bacteriophages as compared to control mice with intestinal microbiomes colonized with *Enterobacter cloacae* strain B29 but untreated with bacteriophage. As shown in FIG. 5, the administered phage cocktail inhibited *E. cloacae* strain B29-induced weight gain.

During week 1 of the in vivo study, all mice received daily doses of *E. cloacae* strain B29 by oral gavage and were placed on a high fat diet to induce weight gain. At week 3, the treatment group (solid line with triangles) received daily doses of the phage cocktail by oral gavage for 7 days. The phage treatment was repeated at week 5. Body weight was monitored weekly throughout the study and was shown to be significantly different in the phage-treated group as compared to the control group at weeks 5 and 6 ($p<0.05$).

The study included 6 groups of 8 mice each. The study groups included:

Group 1: Obese control: mice with normal gut microbiota; developed obesity.

Group 2: Lean control: mice with antibiotic-depleted gut microbiota; did not develop obesity.

Group 3: Obese control #2: mice with antibiotic-depleted gut microbiota inoculated with *E. cloacae* strain B29 to reconstitute gut microbiota; developed obesity.

Group 4: Experimental Group #1: mice administered phage cocktail at beginning of week 3 during antibiotic-depletion, one week prior to first inoculation with *E. cloacae* strain B29; administration of phage cocktail correlates with prevention of *E. cloacae* strain B29 engraftment and prevented development of obesity.

Group 5: Experimental Group #2: mice administered phage cocktail at the beginning of week 7 after *E. cloacae* strain B29 had engrafted but before obesity developed; phage treatment correlated with prevented development of obesity, reduced *E. cloacae* strain B29 levels, and reduced inflammation.

Group 6: Experimental Group #3: mice administer phage cocktail at the beginning of week 17 after obesity had developed; phage administration correlated with decreased low-level systemic inflammation, weight loss, and reduction of *E. cloacae* strain B29 levels in the mouse gut microbiome.

The study was designed to measure the efficacy of phage treatment when administered before exposure to *E. cloacae* strain B29, after exposure to *E. cloacae* strain B29 but before obesity develops, and after obesity develops due to colonization of *E. cloacae* strain B29 within the mouse gut microbiota. Broad-spectrum antibiotics were administered to Groups 2-6 (see group descriptions above) to deplete their native gut microbiota during weeks 1-3, then their microbiotas were reconstituted (except group 2) by twice-daily oral gavage with $1\times10^{10}$ CFU/mL of *E. cloacae* strain B29 during week 4. All mice were fed a high fat diet at the start of week 5 and remained on that diet for the duration of the study.

The methods for antibiotic depletion and *E. cloacae* strain B29 reconstitution of the gut microbiota were tested and proven effective. When the *E. cloacae* strain B29 levels decreased in Group 3 controls during the study, a biweekly "booster" dose of *E. cloacae* strain B29 was administered to groups 3-6. Bodyweight was measured weekly throughout the study. Phage treatments were initiated at the time points indicated and administered by daily oral gavage for the first week of treatment, then by inclusion in drinking water for the duration of the study.

Fecal samples were collected and cultured biweekly beginning at the end of week 4 to track *E. cloacae* strain B29 levels. Glucose tolerance and insulin sensitivity were measured every 4 weeks (as described below) to detect type 2 diabetes. By week 12, we demonstrated obesity in control mice. By week 24, conclusions regarding the effect of the *E. cloacae* strain B29 phage cocktail on body weight and glucose tolerance when given before *E. cloacae* strain B29 exposure, after *E. cloacae* strain B29 engraftment but before obesity developed, or after *E. cloacae* strain B29 engraftment and after obesity were established.

Molecular Level Analyses of Mouse Tissues for Markers of Inflammation and Insulin Resistance Each mouse was dissected at the end of the study and various tissues were preserved. Molecular markers of inflammation such as tumor necrosis factor α (TNF-α), interleukin 1β interleukin (IL-6), toll like receptor 4 (TLR-4), and I-kappa-B kinase epsilon (IKKε) were examined in liver, intestine, and adipose tissue using qRT-PCR. ELISA assays were used to measure serum levels of proteins that influence blood sugar and appetite (e.g., insulin, leptin, and adiponectin), and inflammation (e.g., serum amyloid A and LPS-binding protein).

Some or all molecular markers of inflammation and glucose dysregulation improved in response to the administration of the phage cocktail to mice harboring *E. cloacae* strain B29. Additional markers of insulin activity (e.g., AccI, Fas, Fiaf, Srebp1, Pparq) and gut permeability (ZO-1, Occludin, Claudin) were examined at the RNA and protein levels in tissues. The mechanisms underlying bodyweight changes were deduced by quantification of the molecular-level changes that occurred in mice in response to administration of the phage cocktail.

CONCLUSION

It will be appreciated that systems, devices, products, kits, methods, and/or processes, according to certain embodiments of the present disclosure may include, incorporate, or otherwise comprise properties, features (e.g., components, members, elements, parts, and/or portions) described in other embodiments disclosed and/or described herein. Accordingly, the various features of certain embodiments can be compatible with, combined with, included in, and/or incorporated into other embodiments of the present disclosure. Thus, disclosure of certain features relative to a specific embodiment of the present disclosure should not be construed as limiting application or inclusion of said features to the specific embodiment. Rather, it will be appreciated that other embodiments can also include said features, members, elements, parts, and/or portions without necessarily departing from the scope of the present disclosure.

Likewise, any steps recited in any method or process described herein and/or recited in the claims can be executed in any suitable order and are not necessarily limited to the order described and/or recited, unless otherwise stated (explicitly or implicitly). Such steps can, however, also be performed in a specific order or any suitable order in certain embodiments of the present disclosure.

The present disclosure may be embodied in other specific forms without departing from its spirit or essential characteristics. The described embodiments are to be considered in all respects only as illustrative and not restrictive. The scope of the invention is, therefore, indicated by the appended claims rather than by the foregoing description. While certain embodiments and details have been included herein and in the attached disclosure for purposes of illustrating embodiments of the present disclosure, it will be apparent to those skilled in the art that various changes in the compositions and kits disclosed herein may be made without departing from the scope of the disclosure or of the invention, which is defined in the appended claims. All changes which come within the meaning and range of equivalency of the claims are to be embraced within their scope.

The Sequence Listing accompanying the present disclosure and submitted herewith forms a part of the present disclosure and is incorporated herein by specific reference.

SEQUENCE LISTING (19 sequences)

SEQ ID NO: 1 - DNA, 39670 bp, Unknown
  bacteriophage genomic DNA
tctcacagttcaagaacccaaagtacccccatagccctcctaaagccacctaaagccagccctacccctctggtttaaccttcggttaaccttgggtatctcctcaagtggcctataggatagcctaaagtgttgcctaaagtcaatacctaaagtgatggctgcctattggagacttaaagagtgtcctagtgtaccagttcgatagtacatccctttgtgtccctatctgttagccattcctaaagtaaaaccataaagacaccacctaaagccatcacctaaagagcgacgctatcttaaagacaaccagaccgataagacccattgctaacctgtagtgatgccctgtagttctctatggtgtctatcgttaattcaattaccctcactaaagggaatagggatacttaaagagggaattaaagatttaataaaaaagatttaaattaatggttgactttaagtaacctttaaggctattattcatcacgtcaacgggacaacggccttaaagccactccctgagataccggagtcaaccggataagtagacagcctgataagtcatacgaaaaacaggcattgacaacatgaagtaaacgcagtaagatgcacaacatagcgtcaaccaccaaatcggtgtcttctaggtgacttaagcgcaccacggcacataaagcgaaacaaaatggttgacaacatgaagtaagcacggtacgatgtaccacattgaaacgacagtgaggcgggacactgaaagccgctagggtctaacgaaaccagaccgacacgctctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagctttccgttccaacctcgatgatgaggtgaacatgagtcgccaccgccacatggttagcactttacgtgccgcaccgggtctctatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgcaatgagtgggagcaagattgcgtactggtatacaaatcacagactcacacagcgggattggtgtacgctaaaggtatcgacgggtataaggctgaacgtctgccgggtagcttccaagaggtgcctaaaggcgcaccactgaaagggtgctttacgattgacgagttcggacgccgctggcaagtgcagtaagtgatagactcaaggtcgcactgtatgtgtggcctttatgattatcacttagcacgctataggactaacaccatgagtaaacttctggcaacatctaaaatagaaggccaatgcaccgtaacactgcgtgagtattaccacgggtcaatgggaagcacctacgttgtgcgatacggtaaacaggtcacacattgggtaaacccgattttagcacaagaggattatcaatcttgtgtgttacaccaaacaacatgtgcgggctggaatgattgacattacaggagggttagcaatggttatctttatcgctgtcgcactctttgcggtcgctggctggtactctgagtcacgcaaggccgctcactatcatcgcaagatggttaaactcatggaacacttggacgcagaagggcgaggccgcgaggctatcgaactggtgaaacacgcatgatgattctctttatcgcactggtctatctgtgcatcgcaatgtactttatgcgagactttaagcgcggtctggcaatacacaaggcaacgctgagttactttaagtggggattcatcccacggtttacggttcgtgaacgtaacggacgctttaaggccaataaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagccatccgcaacctaccgattgagcgtctgaacgagcgccagccaatgctggtggctcttgtggctgctatcgtgaactctgagactcaggaggggcaactgacagcggctaaaggaaaccggagtcttgaggacatggactactggcagacgctggcagagcgcatgagggatgttggtttcattaagttaggaaatggtcactttagcgcagcatatgagcacgcgttgttacctggcaaggtcatcaaggtaggctttaagaaagaggactcaggcgcagcctatgcagccttctgccgtatgaaccaaggccgggaaggtatccctacggtgtacgacattcagcgccacgctggttgttacacggtggttcttgactatctgaacccgcttaacgactggtgctacggtgagagtgacaaggtgcgtcaccacttcaaagccgcacgggaaatcattgaggaggattgcttcgataccgccgaagagtacccaataagtgacgggttcattgagacctgcaaggatatccgcaagttcttcttaggcatcgcatcgttcgattgtcacagcggtaacatgatgaaagaccagatgggacgcctgattatcacagacccggtatcattcagcgcagacgacaagttaaagccgggtgagttccactgtgacccggatgaactcatcgctgagattgaggcgctgagagcgcaggaagcgattgaccgctgtaaggcacgcaaggcacgccgtgaccctaaaggagactttcaggtagcacgaaaggcccgtgccaaatggcgcagaaaggcctctaagcgtgctaaacgtgacgctaaggtactcgctaagatgcgcattgatgccaacgagcaacgcagggccgagccgagggcgcgcatgttgtggggcgataagcactggcgtaacgcttgggtgcagcacatgaatgttgactttgcacggctcgaactgttagcagccgcacagatggcacagatagaccacaaggccatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcgtcactgaccagcacgaacatgacaaccattcaggccgctgctggtatgttggggaaggccattgaggatgaggcacgtttcgggcgtatccgtgacctcgaagcgaagcacttcaagaagcacgttgaggaacagctcaacaagcgccacgggcaagtctacaagaaggcctttatgcaggtggtcgaggccgatatgattggtcgaggcctgcttggtggcgaggcgtggtctagctgggataaagaaaccacgatgcacgtagggattcgcctgattgaaatgctgattgaatccacgggtctggtggaattacagcgacacaacgcaggtaacgcaggctctgaccatgaggcactgcaactggcccaagagtacgtcgatgtgttagcgaagcgtgcaggcgctctggcgggcatctctccgatgttccagccgtgtgtcgtaccgcctaaaccttgggtagcaatcaccggaggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcactcaaggagtggaagaaagccgccgctggtatctatcgcttggacaaggcacgagtgtctcgccgtatcagcttagagttcatgctggagcaggccaacaagttcgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggtgcctttccctgagcgcatcgcgttcattgagaagcacgtagacgacattctggcttgcgccaaagacccaatcaataacacttggtgggctgagcaggactcaccgttctgtttcctcgcgttttgcttcgagtatgcaggcgttgcgcaccacggtctgagctacaattgctctctgccgctggcgttcgatgggtcttgctccggtatccagcacttctccgcgatgctccgcgatgaggtaggcggtcgcgcggttaacctactgccaagcgaaaccgtgcaggacatttacggcatcgttgcacagaaagtaaacgagattctcaaacaggatgcaatcaacggcacacctaacgagatgattaccgtgaccgataaggacaccggggaaatctctgagaagctcaagctgggaacctcaacgctggcgcaacagtggctggcgtatggtgtaacccgtagcgtaactaaacgttcggtcatgacgctggcttacggttccaaggagttcggctttcgtcaacaggtactggacgacaccattcagcctgcgatcgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtctcgatatgattttcttagggcaattccgtctgcaaccgacgattaataccctcaaggattcaggcattgacgcacacaagcaggaatctggcatcgctcctaactttgttcactcacaggatggtagccacctgcgcatgacagtcgtttatgctcacgagaagtatggtattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagttgcacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatcttgaagttaaaccgcttgacttccattaagttctacgcttggatgcccggtagtgatgacctccgcaagactgaatttaagttaggcttagggccgtgcggcaaggtggtcacgaagttggaatgttacgcaacgtcctccgggatggtcatcttccagaccactgaggacaacgaaacgaaatccttctactaccagaaaggttcaacgtgtggtcgtatcgaacggacatacagttaaccctcactaacgggagagttagcctcaaggtcgtccaagcgggtggcctttgtgattaactttcaatacacatcaacatgaggtaagatactatgcgtaccaactttgagaaatttaccaagcgcgattcagtggtcaatgagcatggcgaacagtggcaagagcgccgtgaccgcatgaagaaacgccacaagcagcagcgaggtaactcacagaaacgggagtggaactaatgatggtgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgtgtgttcacacgctccgggcatccggtggcatccagaaccttcgagcacagcgacagtgatgtacaaatcaacgcgcagactgcatggctccgcacggttcacagcgatttgaaacactggaagtaataaccctcactaacaggagaatcctcaaggtcacttaacatgagtggcctttgtgattcgaactgattaactttcaaccaatgaggaacaaccttatgaacatcttcaataccaacccattcaaagccgtgtcattcgtagagtctgccgttaagaaagcgctggagacctccggctacctgattgcggacattaagtacgatggtgtgcgcggtaacatcgtggttgacaacgtggctgaggctgcatggctgtcccgtgtaggtaagctgattccggcgctggagcaccttaatggtttcgataagcgctggcagcaactgcttaatgatgaccgctgtatcttccctgacggcttcatgctggatggtgaactgatggtaaaaggtgtagacttcaacaccgggtctggactgctgcgtaccaagtggttgaagaaggataacgccgagttccataacgtaatggtcacaccagacatgctcaagccacgtaaggtgggagtagctaaacgggttcgcacagcctttgagttggacactaagcgcctgagtgtgcgcctgtatgcggtcatgccgattcacattgctgagtctggcgaggactacgatgtgcagaacctcctgatgccgtatcatgtggaggccatgcgctctcttctggttgaatacttcccggaaatcgagtggcttatcgctgagacctacgaggtctacgatatggattcgctgactgaactgtacgaggccaagcgtgccgaaggtcacgagggtctcattgtgaaagacccgcagggcatctataagcgaggcaagaagtctggctggttcaagctcaaaccagaatgcgaagcagacggtatcattcagggtgtcaattggggaaccgaagggttagccaacgagggtaaagtgataggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttcacgggtgggcctttcttcgttcagtggtattaaccctcactaacaggagacacacaccatgtggcttatcctattcgctatcgtcgcaacgctgggattaatggttgccgacgacaacatttggcctgattgttaaggagacaacatcatgcgtttacacttcaacacatcaaatggtatcttttcggttcgccgtgaagaccgctctacagcagtggcctctgagcgcaacgctaagctgccgctgattggctcggtcgtcccattgtcgcctcgtgttcacctactgatcactcgtggagagttcattaaggcgatgaacaaagagcgcccgcatctggaagccgtggtcacttactggcctcgcatccgtctgttcgttaagtggattaaggaggtgctgtaatgttacaggaatattatgatatgcgtagccgcttcccggttaactctgccgttcgttattcaggagcgaaccctttgttcaagggtctgaccggaacagtgcagggctactctcacactggtcgagtcaaggttcgtttcggtattcgtgaggctgaggtacatccttccgtactaatcccactacctaaagtcggcccgaacgtggaagcaccgaaggcagaagtcaagtctgacgtgacccacccgaaccactacatgctgttcgacaacgtggaagccattgaggttatcgcccggtcaatgacagtcgaggcgttccgtgggtactgcttagggaacatccttaagtatcgcctgcgtgctggtaagaaatccgaactggcaacgatggagaaagaccttaagaaagcggccttctatcaggaactgtttgacaaacataaggggctgtgctatgacgcttcgtgaatgttgcgattggtgtgccgctaagtggaaccaagctattgaggctggtgacgaggccgcagccaacgcctatcaacaattgtacgcgctgtgggagcggcgctttaaggaggccaataaatgagccagtgtaacaacgggtgccagtatgcgaaggacgtagggatggagaaccactcctgcgcaaatcgctgcatgtactcagaacagaaataccttctgacgatagaaggaaacaccgagtcatttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcgatggtcgatgaaatcgtgaagactcacgaagaggcttatgctgctgccgtggaagagttcgaagctaacccgcctcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacattaatctggtcgtggtcgatagcaagggcaagaagattcaggacgttccgattatcggcggcggctctaagctgaaagtgaaatactctctggtgccttacaagtggaacaccgctgtgggcgcaagcgtcaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagtacgaagaaaccccggatgaggaagaggacttctaatggctggcgcatacgctgcgcgaggtgtacgcaaggtcggggctttccgctccggcctagaagataaagtctcaaagcagcttgagagtaagggaattaagttcgactatgaactttggcgtatcccttacgtcatccctgcgagtgaccacttatacactccagacttcctgctacctaacggcatcttcattgagaccaaggggctgtgggattccgatgaccgcaagaaacaccttttgattcgtgagcaacaccctgaactggatattcgcttggtcttctcaagcagccgctcaaagctctacaagggtagtccaacaagctacggtgagtggtgtgagaagcatggcattctgtttgctgacaagctaattccggtggagtggctcaaagaacccaagaaggaggttccgttcgataaatttaagactaagaaaggagtaaagaaaaatggctaaagttcaattcaaaccacgagaaaccacggaggcaatctttgtgcattgctcagcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgtgaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgtgtaccgtcacgtcagtgtcggtgcaaagacccaatcaaggcggaggaacacaccgaggaataattaacactcactaaagggatagtcgaaaggccgtccctttgttctcgaagtaggctaaaatatgaacaaaccatacaagcagttctatcaggctccgcgaagacacattcaagtgtgggtcgcagctaatgggcctatcccggaaggatattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtggtagcgtggatttacagaactaggagagaacttcatggacaattcgctagattcagatagcatatttctctatcacatcccatgcgaaaactgtgggagcagcgatgcaaactcgctgttctccgatggtcatacttattgttacgcctgcgagaactggacgcccggtgacggtgagagacctgagcgggaacgtagacaatcaaatgggagaaagcctatgagctatgacgtatgggatttcggcgacagcaacggtcgatactctgacctgactgcccgtggcatctcgaaggagacatgccaaaaggctggctactggctggcgaaagtggacaaccgaatgtatcaggttgccgactaccgagaccagaacggctccatcgtgtcacagaaggtgcgcgataaggacaagaactttaagaccaccggaagccacaagagcgatgcgttgttcttgaagcacctctggtctggcggtaagaaaattgtggtcactgagggtgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgacgcaggccgtaaggcagtcgaagaggccgcacaggttctcccggctggcaaggttcgtgttgctgtgttaccatacaaggacgccaatgagtgtcacctcatgggtgaagacaaagcaatcttggagcagatttggaacgcgaacccttgggtgcctgacggtgtggtctctgcgttgtcactcaaagaccgcgttaaggaagctatgacctccgaggacgctgttggtctgctgttcgatggttgtcaaggcctgaacgatagaaccttgggtgcccgtggaggcgaagtcatcatggtcacttccggttccggtatgggtaagtcaacgttcgttcgtcaacaggcgctggcttggggcaagcgaattggtaaacgtgtcggcctagcgatgctggaggaatccgttgaggataccattcaggacatgatgggcttgaacaataaggttcgtctgcgtcaatctgatgaagtcaagaaggctatcgcagaggacggacgtttcgatgaatggtatgatgaactgtttggagacgatacgttccacctttatgactcctttgcggaggccgaagctgacaggttgttagcgaagctggcctacatgcgaacaggcttagggtgtgatgttatagtgctcgaccacatctcaatcgtcgtgtctgcctctgaggaatcggatgagcgtaagatgattgaccgcctcatgacgaagctcaaagggttcgctaagtcaactggtgttgtgctcgtagtgatttgtcacttgaagaacccagagaagggaaaaccacatgaagaaggacgcgctgtttctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaagtaccagtgccactgcggtcatccagactgtgatggcggaatgtataattgattaaccctcactaacgggaacaacctcaaaccataggagacacaccatgtttaaattcattaacgctttaggtaagctggtagttaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggagcgaacactatgagcaagtcaatcacccacgcaaacaccatccgtctgccagacaccgccgaccagttctcccgccgagtacacatcaatgtgcgtggtgagaaggtaacgatggtctaccgctggaaagaccacaagtctccgaaagcacacactcaacgcatgaccttggatgacaagcaggtcggtcgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccacgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagaatatgttgatggtgctgagtgggtttcgttcaacgagccgatgatggcgtataacgttcaagacgttgtggtcactgtcaagctcttagagaaattccttacagacctccactacttccctgcgggtatggacttcacgaagtacgatgcggatttattctggcgtgaagctggcgaatcagtggatattgaacatcgtgcagcgtggcttttagcgaagcaggagcgtaacggcttcccgttcaacacacaggccattgaggaactttatgtagaactggcagctaaacgcgccgaacttctgcgaaagttaaccgaaacgtttggctcgtggtatcaaccgaaaggcggtaaggaactcttcaagcacccacggacaggcaaaccacttccgagttatcctcgcgtggtctatccgaaacagggtggcgtgtacaagaagcctcgtaataaggcacagcgtgaaggtcttgaaccttgcgacttggacacgagggattacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcacgtacgagtggatgaccctgagaagcaggcgtgcattgacttgattaaagagtacctgatgattcagaagcgtatcggtcaggcggcagaaggtgacaaagcgtggttacgttatgttcaagatgatggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagctgggatagacgccagtggcttagagttgcgctgtctggcacacttcatggctcgcttcgacaacggagagtatgcgaatgagattctcaacggtgacattcacaccaagaaccagaacgctgcggaactaccaacgcgcgacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacagtccctcgttaagtcttccgcttggattggtggtgagcagaaagtccagtggaaacgccgttggattaagggtctggatggtcgcaaggttcacgtcaggtctccgcacgcagcactcaacacattgttgcagtctgctggtgctctaatttgtaagctgtggattatcaagaccgaagagatgctcattgagaaaggcttgaagcatggctgggatggtgactttgcgtacatggcttgggttcatgatgagattcaggtggcctgccgtacagagcacatcgctcagattgttattgacaccgcgcaggaagctatgcgttgggtcggagagcattgggctttccgttgtcgtttagataccgagggtaagatggggccgaattgggctgtctgccactaattctataggagaaattattatggctatgaccaagaaatttaaagtgtcattcgacgttaccgctaagatggcatctgacgttcaggaaatcttggagaaagacattctgcacctgtgtaagcaggttggctcaggcgatattgtccccactggtaaacagaaagagatgattgtccagttcctgacgtatggcatggatgggctgatggccttccttgtgcgaacgtccttccgtgaggccatcaaagatatgcacgaagagtatgccgataaggacagcttcaagctgtctcccgctactgtacgggaggtgttctaatgagtgaatacctgaaagtgctggcagctatcaaaggctgccctaagtcctttcagtcgaactatgtgcgaaacaatgcggctctcgtagctgaggccgcttctcgtggacacattagctgtttgactgtgggcggtcgcaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtacattgataagctggagaaagacctagagttcctgaatgcgcttaaggcgtgtggtgtggataattgggacggatactctgatgcagtcgaaatggtttaagtggaggatgacgaatgagcctaatcacattgaaagacttcgcggagatgcgtgaaggtaagcctgtggagaagggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtttaccgatgatgtgaactggcgtaaggtactggttgatgagacctataaggagaaccgtaaggcgacccgtaagcctgtaggctaccgtgacttcctgtcgaagctgtgggagcgcgatgagttcattcacatcaaagaggacatgcttgaaggtgatgacgttatgggcatcattgggtctggtcacgaggtcttcggcttcaagaaagctgtgttggtctcctgtgacaaggacttcaagactatcccggacgttgacttcctgtggtgtaccactggtaacatcttgacgcagaccaaagagaccgctgattggtggcatctcttccagaccatcaagggtgatatgactgatggctactccggtattcccggctggggcgatacagcagaaggtttcctgaatgacccgttcattgtggagcctgtagagtccgtgttgaagtctggtaagaacaaggggcagacagtaaccaagtgggttaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacttatggacgccgcaaagtacataaccatcgctgtgctggtaggtatgctggcgcgaggtctctggatgttctctctcatagtccgagacgtgaagcgagactccgagattaagtgataaactcaaggctctctacaattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcttatgtgatggagtctggggagtaccgtgcgctacgcgctgctggatactctgagtctttcattgcgggtgtgctgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgccgaaccagcacctttgactgaaccaccgaaatctgtggtatggggaggcgatgacgatgaggacaccagcgtgtcttcctctgaggtgccaacctcaccgagcagcggtaagagcagtcttaaggtaaagctggatgacagcgcagccaagaacaagagtaaatcctccattcgctccaaagcgtttgggtaactgtggcataacatagggagaaacatcatgggattcttcaagaaaatcaagaaggccgttaagaaagtagttaaggaagttggtaaaccgatcgagaaggctggtaaggaagtcggtaaagccgttggaggcgcgctgggtgcaggtaagcaggagattatccaacaagaggctcctgcaccagtagtcgctgcaccaccaccagcacaggttgtagatgtaccagaacaggataaggctgagggtgagggtgaggcgcaaaccgaaagcgcacgtaagaaagcacgctctggcggtaagaaggcacttagcgtagctcgcagttccggcggtggaatcaatatctgaggaggactgaatggctgattcaaaacgtacaggattgggcgaagacggtgctaaagctacctatgaccgcctaacgaacgaccgtagagcctatgagactcgtgcggaaaactgtgcgcaatacaccattccgtccttgttcccgaaggagtccgataatgaatctaccgactacacgactccgtggcaggctgtaggtgcgcggggtcttaacaatctggcctctaaattaatgctggcactattcccgatgcagtcgtggatgaagctgaccattagtgaatatgaggcgaagcagcttgttggagaccctgatggactcactaaggtggacgaaggtctgtcgatggttgagcgtattatcatgaattatatcgaatccaacagttaccgtgtaacactctttgagtgcctcaagcagttgatcgtggcaggcaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgagatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatcgttaagatgagcatgattagtgcgaaggtcatcggtctggtgaacccggctggcatcacgcagccccgtagattaaccaaagctcagactggtgacttcgttcccggtcgtcgagaagacattgacttcctgcaactggagaagcaagctgactttaccgtagcgaaagctgtgagtgaccagatagaagcacgcttatcgtatgcctttatgttgaactctgcggtacaacgaacaggtgaacgtgtgaccgccgaagagattcgatacgttgcgtcagaactggaagatacgcttggtggtgtctattcgattctgtctcaagagctgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcattgatgatgcaggatgcggcccaaacaggtatcgagaacgctgccgcaactggtggggctggtgtgggtgctctagcgacctcaagtccagaagctatgcaaggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaataacgcggtaatgaccggaagtacacctactgaacacgaacagaatatgctgagtctcgatgttgctgcccgtgatggcgatgatgcaatcgtacttagcgaggaaccgagttctaataacgatgacccttatgcgtctggtgaagacccattcgctgatggtgaagacgatgagggccgcattcaggttcgtatcagtgaagatggtagtgaagctgagttcgacactggtagcgataatgctgaggtggagaccgaaggtgaagccgctgagtttgagccgctgggcgacactccagaagaactgagccaagtgaccgaacaattaggtcagcacgaagaaggctttcaggcgatggtcgagcaggccgttgagcgtggactgagcgcagagtctgtgactcgcatctacgaagagtacgaagccgatggcatctctgagaaatcctatgcggaactcgaagctgctggatatagccgtgcctttgtggactcctacatctccggtcaggaagcccttgtagaccagtacgtcaatcaggtagttgcctttgctggtggtaaggagcgctttagcgcaatccatacgcacctcgaagcaaccaacccggctgcggctgagtcccttgaggctgccatgatgaaccgagacttggcgactatcaaagcgattatcaatctggctggtgagagttacacgaagaaattcggtaagcctgccaaccgtagtgttaccaagcgtgctactccggttaaacctgtagctcgtcagaaagagggctttacgaatcaggctgagatgattaaagctatgagtgacccgcgttaccgtagcgatgctacctaccgtcaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacaatcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggcgctgtactagctgaactggctggtctggttaacctgcctgacgcatccaatgagaacatcgagggtctcggtaagcctaccgtactgactctggttaagccgaaagctggcgacctgactgacccggttgagctgggtaaagcaattattgctcagttaactatcgcgcgtgcggcgctgaccaagaactacgttccggctgctgaccgtactttctacaccactcctgataactactccgcgattctggctgctctgatgccgaacgctgcaaactatcaggcgctgcttgaccctgagcgtggtactatccgtaacgtgatgggcttcgaagtggttgaggttccgcacctgaccgctggtggcgctggtgatacccgtgaggatgccccggctgaccagaagcacgctttcccggcgacttccagcgctaccgttaaggttgctctggataacgttgtgggcctgttccagcaccgctctgcggttggtacggtcaagctgaaagacttggctctggagcgcgctcgtcgtgcgaactatcaggctgaccagattatcgctaagtacgcgatgggtcacggcggtctgcgtccagaagctgctggtgcaatcgtgatgcctgctgcaaagtaatcagcggtgcggacgaagtggcaagctctaacgatgagttaacgcctgcacagaaagccgctatcacgagggcacgtaacaaggctctcaaagaggccgccgagtaaaacctagcaaaccccttgggttccctctttgggagtctgaggggttttttgctttaaccctcactaacaggaggtaacatcatgcgctcttatgagatgaacattgagaccgcagaagagctatcagccgtcaacgacattctggcttccatcggtgagccaccagtatcgacccttgagggtgatgcaaacgctgatgttgcaaatgctcgacgtgtgctcaacaagattaaccgacagattcagtcacgaggatggacattcaatattgaggaaggtgtgactcttctaccggatgcgttctctggtatgattccatttagctctgactatctgtccgtaatggcaaccagcggtcagacccaatatgtcaaccgtggtggctatctctatgaccgctctgcgaagaccgacagattcccttctggtgttcaggtcaacctgattcgtctgagagagttcgatgagatgcctgagtgcttccgtaactacatcgtcaccaaggcatcacgccagtttaacaaccgcttcttcggtgcgccggaggtagacggagtgttgcaggaagaggaacaggaagcgtggcgtgcgtgcttcgagtacgagctagactacggtaactacaacatgcttgagggcgattcattcacctctggtctacttaaccgctaatcataaggaggctctatggctctcattagccaatcaatcaaaaacctcaagggtggtatcagccaacagccagatattctccggttcgctgaacaaggtagcgtacagattaacggttggtcttctgagtccgagggtctccagaagcgcccaccgatgattcaccttaagacccttggcgctgctgggtatgtgggtgcgcaaccttacgttcacctcatcaaccgtgatgagttcgagcagtattttgttgtgttcactggtgaagacattaaggtgttcgacctcgatggtaaggaataccaagtacgtggagaccgctcttatgtacgaacagccaacccacgggaagaccttcggatggtaacggtggctgactatacctttgtgactaaccgcaaggtggttgtgcagagtaacgaccaatcggtcaaccttccgggctttaaagaccaaggcgatgcgctgattaatgttcgtggtggacaatatgggcgtagactctcaatcgagttcaacggggctgagcgtgctgctgttcaactaccagacggctcacaaccagcacacgtcaatgaggttgacggtcaggccatcgctgagaagctggcggctcagttgcggaataacctagggaacccaaacaatgaacaaaacccaaataagtggcgcttcaacgttggccccggattcatccatatccttgcgccaaataacgataacgtttggggactacagactaaggatggttacgcagaccagctaatcaaccctgtaacccattacactcagtcgttccagaagttgcctattaacgcgccagatgggtacattgtgaagattgtgggtgacacctccaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggcgatgacacaaccaacccatacccatcgtttaccggacagacaatcaacgatattttcttcttccgtaaccgtttaggcttccttagtggggagaacatcatcttgtctcgcacctcgaaatacttcaacttcttcccggcatccgtgtcaaactactccgacgatgacccaatcgacgttgccgttagtcacaaccgggtgtcaaccttgaagtatgccgttccgttctccgaagagttgctcctgtggtctgaccaagcgcagttcgttctgacagcctctggtatcctttcgagtcgctccgtagagttgaaccttactactcagtttgatgtgcaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacataccgaatggggtatttagtatatcggggacaaccgctgagaacttcgcggctatccttacgagcggggcacctaaccgagtgtatatctacaagttcctctacattgacgaggaaatcaggcagcagtcgtggtctcattgggactttggggacaacgttacggtgttcgcagcacaggtcataaactcaacaatgacagtattgatgagcaatgaacatgctgtgtggatgggacgcttacacttcacgaagaactccatagaccttccgggagagccttacagattatacatcgacgctaagaggaaatacaccatccctgccgggacgtataatgatgatacctaccagacgtccataagcctctcaacgatttacgggatgaacttcacgaagggtagggtttcggtggtctttcctgatgggaagattgtagagatagaccagccaatcaacggttggagcagcgacccggtgttacgacttgacgggaaccaagagggccaagtggtttacattgggttcaacatcccgttcacttatacgttctcgaagttcctcatcaagaagactgctgaggacggctcgacggctaccgaggatattggtcgcttacagcttcgtcgtgcgtgggtaaactatgaggactctggagcgttcaccatccgtgtgaacaacctgtcccgtgagttcatctacacaatggctggtgcacgattggggtctgacaacctccgcgttggaggctcaaacattggtacagggcaataccgcttcccggtggttggcaatgctcagacgaacatagtaactatcgagtcagacgcatcaaccccattgaacatcattgggtgcggctgggaggggaactaccttcgtcgttcttctggcatttaacttaaagtctccctgtggtgaattaaccctcactaaagggagacactaatagatacgaggggttaaagcattatgtatattacaaagtgtttacaaatccatgccgacaactttcagccgtccatagaggacattctggaagctgaggcactaggtgttgaaccaaaggtaattcctgatgagaacactgtgacaatgctcagagataacgctgtgttggcaatcggtggcaatcagggagaccgagtgtggttccttacctctaagtacgtccaactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcaacgtgaagacctgtaagaaatgcggagagatgaaagctgtctccgagttctataaggacaagaagagtaatgacggcctacgaagtcactgtaagccatgtcactacacgtattacaagaaggactactcaaaggcgcgagagatgaaccttaagcgtctgtacggaatcactctggaagaatatgaagcgatgctccttaagcaagacggagtgtgtgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaaatgattatgtgttggatggcagcaattcctattgccatgatgggtgcccaagctctgagtagccagaacagtgcggacaaggcgcgagtggcacagaccgaagctggacgcagacaggcaatggagatggtcaaagagatgaatatccagaatgccaacgcctcgctggaacaacgggacgcccttgaagctgcatcctctgagttgacttcacgtaacatgcagaaggtacaagctatgggaaccatccgtgcagctatcggcgagagtatgctggaaggcgaatccatgaagcgcatcaagcgtatcgaagagggcaactacattcgggaggcaaatagtgtcaccgagaattaccgtcgagactacgcgagtatctttgcgcaacagttgggacgcactcagtcaacagcaagtcaagtcgattcaatatacaagagcgaggccaagggtaagtctggtctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccctaggtcgattcgctaaggctggtgccgatatgtacatggcgaaagatgaacgtgataagcaacgagccgatgagcgttctaacgagattatccgtaagctgacccctgagcagcgccgacaggctatccagaatggtacactgctgtatcaggatgacccatacgcaatgcaagccttgaagttcaagaccgggcgtaacgctgcgttcctagttgacgatgaggttcagcaggccatcaaagagggtcgcttccgtactcgtgaagagatggagcagtatcgtcactcacgcctacaggagcactcgaagtcgttcgctgagcagttcggcatcaatgagatggacgaggaataccagaagggtttcaatgcgaatatcaccgagcgtaacattgctctgtatggggcacatgataccttcctgagtgaccaagcgcagaagggtgcaatcctgaactcgaaggttgaactcaatggcgtcctgtccgaccctgacctgctgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactcttaatggcgctacgactacctatcgtgaactgatgggtgatgagcagtggcaggcaatgatgattaaggcgcagcacactcaattccagaacaacgcgaagttaaccgagaagttccgactggatattaactcggcgcttaaccaagcggacactggtaaaggctgggagactcttcaaggcatcaaggccgaacttgataagattcagccgggtgaagagatgactcctgagcgcgagtggttgatttccgcacaggaacagatgcgcacacgcttcaagcaggaacaggctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagcgatatggtcaactacgcgaaccagaagttagcggaaatcgaagcgatggacttaacacctgaacagaaagacaaactgaaattggactacctacgggcagactccaaggagggtgctttccgtgcagcgtttggtgagatgattactgatgctggaaacgagtggcaggctgcggtgattaacggtaagatgcctgagagcacgccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggctgctatgatgaacgactcaacgaatcctcaaatcaagtacatgccttcgagtgtccaagggtatgcccggaagatttatgattccgtgaagtaccggacagggaaccctgacatggcaaccgaacaggtcgcaaagttcctctctgattcaacgactacgttctccagtagcgatgttgagggtgatacctatggtgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttgctccagcgtgagtaccagcgtaccgcacagatgcaagctgaggcagcacgagagaaagctctcaaagaggccaataagcgtgctccaatcagtcgtgtaccacaggcgcgtgaagaagcgcgtaaacgtgtccaagagaaacggaagaagactccgaagtacatctatggacgtaaagaagactaacagtgataaggaggctccatgagctacgataagaacaaacctagcgagttcgatgggttatttcaaaaagcggcagacaaacatggggtctcctatgacctgcttcgtaaactagcattcaatgagtccagtttcaatccaaaggccaaatcaccaactggcccgaagggtctcatgcagttcaccaagggtacagctacagcgcttggcctcaaggtaactgatgcagacgatgatgaccgttacaaccctgagttggctgtggatgcagccgctcgtcacctgagtgacctcattcggaaatacgatggggatgagcttaaggcagccctagcgtacaaccaaggcgagggcagaaatggtgcccctcagatgcaggcctacgacaaaggtgattgggcttcaatctctgaggaaggtcgtaactatatgcgtaacctgatggacgtagctaatagtcctcgcaagggggacttggaggcgttcggcggtatcaccccaaaggctaagggcattccatcgggggatgcatttgctggaatcgggaagaagcagacggtaggcactgacctgccggagtcaacgggattcaaagtggagggtaaagagcagcaagcgcctaacgttccttatgctaaggacttttgggaaaagactggaacaacactggacgagtttaactcacgctctaccttcttcggaattggtgatgcaacaagtgcggagcttcacaactctgtacttggagttgctttccgtgcagcccgtagcgacgatggttttgacttgttcaaggacaccattacgcctacccgttggaatagccatacgtggactccagaagagctagagcgaatccggaaggaagtgaagaaccccgcgtacatcaacgtggtcactggaggctctcctgagaatctggacgccctcattaagatggcgaatgacaactatgagatggatgcgcggtctgccgatgctggtgttggggccaaacttactgctggtatcgtcggcgctggtgtagacccgctgagttatgtaccgctagtaggagtagccgggaagggtctcaaggtgattaacaaggcgctcgtcgttggtactcaaagcgctggattagcgattgcatctgagggtatccgcacatcaatagctggtggtgaagcacactacgctgatgctgccttaggtggtctcttgtttggtgctggtatgagcgcaatcagtgacgctatcgctgctggtgttcgccgttcccgtgggactgaggttgttaatgacttcgctcctatggcacaccgcttggaagcccgtgagaccgctctgaactctggcggtgaagacctgacccgtatgcctagcgagaaccgtgtgttcgaccgtgagcacgctggcgttgagtattccactctggagaccgagccgggtgccgttgtgttgcctcaaggtcaaatccttagcgacacaaacccgctgaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgttctccgacagggatggaatcaggctctaatggtaagttcggtgcgactgcttctgacattaaggagcggctccacgcgaacaatcagcgcacctacaaccagctttatgatgctgtgcgtactgcaatgaaagaccctgagttctccacaggtggggccacaatgagccgtaaggaaatccgacaggaaatctacaagcgtgcagccttggcgattgagcgacctgagcttcaagcaaacctgacaaatggtgagcggaacgtgatgaacatcctcaagcagcactttgacctcaaacgtgaaatcatggagaacccgtcaatcttcggcaacaccaaggcggtcagtatcttccccggctcacgccacaagggaacctacgtgccaaacgtgtacgaccgcgctatcaagattgagatggttaaacgctacggtaatgatggcctgcagcgagcaatcgcggagtcatggttgacttcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacactgaccagttctctgcctcctctgtcattgaggataacattgagggtctggtgggcatcgagaacaacaacttcttggaagcccgtaacatgttcgacagtgacatggcggtgactctccctgatggcaacacgttctctgtgaatgacctgcgtacctatgacatggctgaaattctgcctgcatacgaccgacgagtggatggggatgttgcaatcatgggtggttccggtaagactaccaaagacctgaaagatgaaatcatggcgctggataagcagtcagagggtaacggtacacttaaaggtgaagtggaagccctcaaggacaccgtgaagattctgactggtcgtgctcgtaggaacccggaaggcgcttggggtacggccctgcgctccgtaaatgaccttacgttcttcgctaagaacgcctacatgggtgcacagaacattactgaaatcgctggtatgctggcgaaaggtaacgtctctgcgataactcatggcatccctgtgattaacgattgggtcaaccgtggtaaaccgcttcgtgcctctgagattaaggagatacacgggatggtgttcggtaaggaactagaccaactaatccgtccgggacgcgaagaccacgtgcgccgactccgggagtctacggacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagaccatgcgactcgtggagaagacggtaagttcaccattcgtgacaaacaggctttcgctaacgacccacgttcaatggacttgtggcgattggctgacaaggtggcggatgagactatactgcgccctcacaaggtttcctcacaggactccaaagcgttcggtgcaggggtgaagatggtgatgcagtttaagaacttcgtcatcaagtcccttaactcccggttcgtccgtagcttctacgaggcaactaagaacaaccgagcgttagaccaagcgctgacccacataatctctttaggtctagctggtggttactacgttgggcaggcgcacctcaaggctgcaagcctacaggagcacaagcgtaaggagtacctcaagaacgcccttgaccctaagatgattgctcatgcgtcaatctctcgtagttcacacttaggctcaccattgagtatctacgatatgttagctgggatggttggtagcgatacctataagtacacccgctctacggtgctccctaaagagtccgagaagcgtgaccctaacaaggcagtgacaggtaggcaggtggcttcaactatcgcaggtgcagttggtgagcaggttccgggtttaggttttgttggctctgtgggtgcaacagctattaacgccgcttccctgctgtcttctccgaacaaggctaccgctctggagttccgtacaggactcttcaacacctctcgtgagttgattcctaatgacccgctatcacagcaactcattatgaaaatctacgaggctaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggctcgtaagttcgtccgagtgacccttatcggtgttgaccgaaaggaactcatcttgaatcaagactatcgttttgcgactaagaccacaatctccacaacgagggcgttggggccagcggacggttatactttgattgaaatccgtcgattcacctcagctaccgataggctggttgactttacggatggctcaatcctccgtgcgtatgacctgaacatctcgcaggtgcagaccctccacgttgctgaggaagcgcgtgaccttaccgctgatacgattggcgttaacaacgatggtgacttggatgctcgtggtcgtcgtatcgtgaacgttgcggacgctaaagaccccggtgacgcaatcaacttaggtcaagtccagaagtggaacgactctgcgttgaactctgcgaaccgcgcactggctgaggccgaccgtgcaactgtgcgtgcttccgaggctgccacctctgcgggtaactctgcgagttctgcaagcctgtcccgtgattgggctatcaaggaatcgccggtggaaggagcctttaagtcttcccggtcgtatgcccttgactctatggcgtaccgggatgcgtccaagagttctgctgatgctagtgctgcaagtgctggtgccgctaagacctctgagattaacgcgaataactcaaaaatcgctgcgaagacctctgagaccaacgcgaagacctctgagaccaacgctaaggcttccgaggaacgagccattgaggaagcaaataagctggagaacatgaatgatttggctggtgcaatcaaagaggttctcaagccagaaggtgatacttcgggcaaggttgtgtggaaatacgatattgacagtaaagtcctccgcgcctacaacggtatgtcgattggttgggattgggatggtactggtagtccattcatgaatttctaccgtgggcaaggcgagccatctggttcactacggcttgacgctaacaaggttgttcgcttcaatgggatgaactctgttgacttcgactcaaccattaacgctcaggccatcaacggctcatggattcattctactggcgatttggttgcagacgcgactctgtacgtgcatggtggtgattatatttataaggacaagtgggttccatctggtgcaaacaagattacaaacctcattcgaggctctgttggtggttttgcttgcgatgaattcttttccgagattgtaggttattatattgagcgtgtctggcaccttgttggtggggacaacgatacgtggatgcgaatcaaaggaaatggtaactttgagatcggcggtaaccgaggcgcaagaatcgtcatcaatggtggggcgattgtcgaacaggatggtaacattcgtggatctatctgggagggtaagtggctgagggacttcatgaacgaccgcttccttaacgatgtgtggcttggcggtcaagagtgggtatccacgaacggcggcgctcgtatcgactacgcattaggcggtggctctgtgtgtactggttacactcaggatgctactggcggtgttcggaatgcgtggcttgatggtatgttccaccgcaagctgtggattcgatatggtaacgggtctgctcgtgttatcggctcggcttaattcataaaggagattactatggaagtttataataactggaagtggactaatggcgagagggtaagtggtgataactttatcattgagattaccagagatggtgtctcttggtatgaccttatggtcgaactggatgagcagagtaaccgctcagtcgtatgcgtgtctcctgaaggtgacatagcgtggatgacccaaggcgctgtctctgagaagttcgcaccctctgatggctattccgttatcgttaccgagtcaactccgttcactaaagagacttggcgtgactataagttcgacggtgagaagttcgtcgagaaacctaaagtagtaggggctgtccgtaccaaagaggaaatcatggctgacctgctggctctgcaagcggagttacagaaactataaggagaacaagaatgttatcttttgacttcaataacgaggtcgttaaggctgcgccgattgttggcacaggggtcgctgatggtgcggccagactcttttggggactatcgttaaacgagtggttctacgttgcagctatcgcctacacagtggttcagattggtgccaaggtagttgataaaatgattgactggaaacgtgcaaataaggagtaacctatgagcgacaagactttaatcaagctgctggagatgctggacacggagatggcacagcgtatgcttgctgacctccagaacgaggaacgccgaacgccgcagctttacaacgccatcggcaaactgttagaccgccataagttccaaatcagtaagctgaccccggatgagaacatccttggcggtctcgcggctggtctggaagactacaacaaagtggtcggccctaatggtctgactgacgatgagactatcacgctacagtaagtgacatactcaaggttctccacgcggggagcctttatggatgttatttggcgcatctatgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgagtacattgcgaaaacaaaagctgatatccaacagcataatgcagtacagacagccctcgatgccattgctaagcggcactccgatgagatggctgaacttgaggggagcactgatgggattgttaatgctctcaatgctgataacaagcggctgcgtgtcaaactcaaagctatcagtggaacacccggcgataaacagcagtgtatcagcacagttgatggaaaagccgaacttgacgaaggagatgctaagcgtcttatcggaatagctcagaagggtgataagtggattgagaacctacaggacactgtgcgagttctccaaggtaaactcaaagagaaggagacgaagtaatggctatgggaagaccaagggcgtctcagttagagcgggaatgttcggcctgcggtatgactaagcccgtttctgagtttcataagaatggcaccctgcggggtgtccctcagtataaaacaacttgtaagccatgccgtaaggctgcaaccaaaccagacacctacaggccatatcacctcaaggctcgttacggtattaccgtggatgagtatgacgcgttggagaaggcccaaggaggagtgtgtaagatttgtcagaggccagagactcagcgtaagagactagccgttgaccactgccacactactggtgctgttcgtggcttactgtgtacaacctgcaatgcggcaatcggtcatctattggatgacccagagattatccgtagggctgctgactacgtaggaggaaccattgagtaactcacaagaggcccgcaatgccttaatagttgcgcaacttaaaggagattttgtcgctttcttatttgtattatggaaagccctttcgcttccacaacccactaagtgtcagattgatatggcccggtgtctggctaacggagataacaagaagtttatcctacaggctttccgtggtatcggtaagtcattcatcacctgtgcgttcgttgtgtggacgttatggcgtgaccctcagttgaagatactgattgtctctgcatcaaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccactgcctacttctcgcgttatctaccttggcacacctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgacccagtgcgcttcgatatggaagacctgcgggagcgtgagttggaatacggtaaggctggcttcactttgcagttcatgctcaacccgaacctgagtgatgccgagaaataccccttacgcctccgtgacgctatcgtgtgcggtctggacttcgagaaagccccaatgtattaccagtggcttccgaaccgtcagaatcgcaatgaagagctacctaacgtgggccttaagggtgatgatattcatagctatcattcgtgcagccagaacactggacagtaccagcaacgcatcctcgtgattgaccctagtggtcgcggtaaggatgagactggttacgcagtgttgttcaccctgaatggctacatctatctgatggaagctggcgggttccgcgatggttattccgacaagacccttgagtccctcgctaagaaagcgaagcagtggaaggttcagacagtggtcttcgagagtaacttcggggatggtatgtttggtaaggtattcagccctgtgctcctgaaacaccatgcagccgctatggaagagattcgtgctcgtggtatgaaggaactacgcatttgtgatacgctggaacctgtactctctacgcaccgccttgtgattcgtgatgaggtgattcgtgaggactaccagactgcccgtgacgctgatggcaagcatgacgttcgctattcgttgttctaccagttgacccgtatggcccgtgagaagggcgctgtggcacatgatgaccgacttgatgcattagcattgggtgtggagttcttacgctctacgatggaactggacgccgtgaaggtggaggctgaggttcttgaggcgttcttagaggaacacatggagcacccaatccattcggctggtcacgtagttaccgctatggttgacggtatggaactctattgggaggatgacgatgtgaatagcaataggttcattgactggtagttatgcacatttaacggataaagattcaatgagaccacggatggtcactttaagaaactccttaagaatcaacgagtttgcattaaccctcactaaagggagagaggggacttaaagctactatataggttagtcattcaggttatgcaatgaccctttatgcactttaagtcccacctctatgattggtgatattatcattgtataatcaccctaccttagagcaactgaaaggaggtggctcaatgttacgcttgctgattgccctgctgcgtcatagagtcacttggcgatttcttctggtacttactgctacccttgggtacgcaggtcttactgaccacctcggtcaactggaagtggccttttgctctatactctcttgtggggattaaattattgttgatgaccgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctgtggtgtggccttacctaaagtggttgcctaaagagaccctttaagaatttaccacaaaaatctgaatgggtatctcacagttcaagaacccaaagtacccccatagccctcctaaagccacctaaagccagccctacccctctggtttaaccttcggttaaccttgggtatctcctcaagtggcctataggatagcctaaagtgttgcctaaagtcaatacctaaagtgatggctgcctattggagacttaaagagtgtcctagtgtaccagttcgatagtacatccctttgtgtccct

SEQ ID NO: 2 - DNA, 81681 bp, Unknown
  bacteriophage genomic DNA
gtacctgctgatgacgctgccattctgtctggcgtcgttcggctaccacggcaacgtaccgagcctgatgaaatactacggcaaggatccgcgcaccatcgtgaaatgcctgggatgtacttgctcatcctcgcttctgkgggctacgagktkwakyyctgactcaccaaycggattccaagtggatttctgtcacaaccggttactcgggagattatcctggtggttcagggataaacctaggacccttcttgacacacagagtagctgactgtattatcatattagatgtggtagaaagtgggcctagtgtttaccagtttaccctaaagtttgctggagaccatgaagaccttaagtctgtggtccgcaagagcaactatcaaggctggtatctaaatctttaactcaaccgtttacatcctccgtttaatggtatactatagactagaaatcaactaacggagaacaaaatgaacatcatcaaaaagattcttaaagctatatggacgatgactttggtgttagttctttttggagctttcgcgttcgccttagcacatgatgtggtaatggcatggattaacttttgaggaaaatattatgcgtcgcaagactacctttggttctcgtatggataaaatggaaaagattttctggattttcttttctgttgtagttgttttaattgttgctggaattggttttagcatttgggctactgttgagattgttcaagcagtacaaactgatgggctcaagagtgtagtagaagttctgtggaacggggctcagcaaggtactgaattatgaaaatcttaaaattctggttaaatggtattattgctattgcgacagcttatgttggatttaatttggcatattggcttggtttaagtgagtatgaagtgcttattgaaattattaagcactaattcagggccttcgggccctatgaggataaacttttaattgattgaggaaaatgatatgcgtgattatatgactcgtggtgaccttgaagctgttggtgcaactgttgtgtgtactgttaaaaatggtgaaactgtaggttacgttgacccatctgttctggctgaacctggcttctacttcatggtaaaaggtgcttcagcttggcgtgcagtagcagcacgattttatgttggtcgtcaacgttcaaaatctggctttatgaatgttctgtcgcagattcgccaaggtcgttctcagcttggtcgtactatgcgttcaaataacgtcatctacgatgtgtacttcgttccggctgataaaatgaagcctttgactactggttttggtaaaggtcaattggcgctggcattcacacgtaaacataacgattcttatcagaacctggaagaaatgaatcgcatgttgaatgataacttcaaatttattcttcaggcatattaatatgagtccgttcaaacagatttgggctttggtgttcttgctcatggctccgcttttcatcgcttctggtctgtttatttgggaggggttaatccctccgccaagagtcattggaagcatgtgctttggtgtagctgcattagctgtagaacgtttgttctattacgtaggtttaacaaaatgaaactctcaataggcgttattggtgtgtcaatattactctccggcgctttagccggagcagtttatgtgatgggcgaaatagtgctttttcttgctcgtgttatgatgaacatcggtaatttaatctggtagggtaatatgacaactatttttgacatgatgtctaaacaactcgatgactctgttggtcaacttaatgtaagaaaccttcaaagcatcattgacaatgaagccaaagaatttgcaatctacacagtagaaaaccgcgcaattcctaacctgattgatggtttcaaaccggttcaacgatttgttattgctcgtgcactagatttgtctcgtggtaataaagaaaaattccataaacttgcttcagtagctggcggtgttgcagacctcggttatcaccatggtgaaggttcagcacaggatgctggcgcactgatggctaacacgtggaacaacaactatcctcttttggatggtcaaggtaactttggttcacgattggtacaaaaagcggcagcatctcgttatatcttctgtcgtatttctgacaatttccgtaaggtctacaaagatactgaaattgctcctgagcataaagataaagagcacgttccgcctgcattctatcttccaattattccaactgttcttctgaatggtgtacagggaattgcaactggttatgctactaagattcttccacacagttttgaatcagtagttgaatgcactaaattggctcttcaaggaaaactggataaagaaccagaagttcaaattccacaattccgcggtgaagtggttcgtcttgaagatgggtcaattgaatgtcgtggtctttataagttcacttcagcatctcaaatgtatatcagtgaaattccagctaagtttgaccgcgaaacttatgtggaaaaagtacttgagccaatggtagataagaacttcatctcttacgttgatgattgttcaaagaccggctttggctttaaagtgaagttcaagaaagattatatgcttggccaagacgatgagcagcggcatgagaaaatcatgcgtgacttcaaattggttgagaagatgtctcaattcatcgtagtcattgatgaaaacggaaagttaaacgataagttccaaagttcttctgaacttatcaagcactttgtggaagttcgtaagacttacattgtcaaacgaattgaacacaagattgttgaatgcgatgaagcattcaaattggctttggctaaagcgatgttcatcaaagaagttattgaaggtagtattgtcattcaaggtaaaactcgcaagcaacttacttctgagcttgaatctcgtccaacttatgaaccatttgcggataagttggtttcaatgaacatctatcacatcacaagtgatgaagccaagaaactagctcaacaagctaaagacttgaaagctgagctgaagtactggcaagaaactactccagaaatcgagtatatgaaggaccttgaggctctctaagagcttctgtatcactctaaacggctctagtgaattctagagccgagtccatataattaatcatcctttctacacacattccctcaaccgttctggttaacttcaaaaattctttcaatcaaccgtttacaacacgttttgcttatggtattatagctctatcaaaaccaaacggagtaaacaaaatgatttcagttatcgttgctgccttaacaaatgctggtattatcgcggaaacttctgatttcgcttatgttaaattcaacagaatgtcaattgacaaaaatactcaagcacgttattgggctatggtttatgaccataatgaaagtcaatacattttaactgaagttctgattgatttagaaactttagaggcagatttcgcaggatgccctgaacttgaaggcgaatttgaagaagtcttagaagcttatgtttcaaaatgaggaaattatggaaactttaatcaataacttaaatgctttactggctaactcaggtgttgaccttgacgacgcaatgcatgcagcacgccttcactcatcaaacactgatagcaatagctatctgacaatttggtataacagcgaaagcgaaaactacgtgctggtatgggtatacgtcaacaactatgacatgactgcagtgcttgatgcagaagttgaagatgtggcagaaactctaaacgaagctaagaagctctttgcagacttcttccgaggttaagctgtttgatagcatctttttcggaaggtgctaaactaaccgtttacatcggcttaaaagtttgatactattatctcatcaaaacaaatactgaacctggagaaacaaaatgtctaaagtaatctatatcgttaaagcttctgaaaactctatctctgaaaatgctgcaaacgttctgattgtagtcgctaagaaagacttcatcacttcttccgaagttcgtgacgttctggcagataaactttcagctgcttcagttaacagcaacattggtgttctgattaagaaaggtctgattgaaaaatcaggtgatggtctgattgtatctgctgaaggtcaagaaatcatcaaccaggcagcagttatctacgcagaagaaaatgcaccagaacttctggaaaaacgtaacactcgtaaagctcgtccgattactgaccagatggaagcagacaaaaatctgatgatggaactgctggctaccaaagataatctgttcacaatcaaaaaactggacgtctatcgtagcaacttcatcgcggtactcgaaaaacgtaccttcggtattcgcagcttcgaggtatcaaacaaaggtaacttccgtatctctggttacaaaatgactgaagaacaagttaaacacttcgaagacctcggaatggttgctaaacattctaaaaacggtaatgtatacctggacattccacgtactcaggaaaacattgaaaacatcatccacgctgttgacactctgcaataaggaaattaaagatgaaaaacttaaactctcatgtacttcgtgttaaaaagttaatgaatcgtccagaaactttgaatgaactgcagcgttgtattgaacgagtaactgataagtactatttgccaaccgatgcatgggaagtctggttccgtggaacacatcttggcagtattgaacttaaagctaaaaatgtttacgcagtttatagttctcatggtcgtcactgcggtgaacattctaacttcatgaaagcactcgcagaattcatagattcatgtgcggtggttatcgcctatgatgaaattaaagcaacagaagaatggattaaagaagttactaaagaacctgaacttcgtacttggggtctccgcgaaccaaaaacaatctggcagaaaattaaaggattcttcaaatgagcaaattttcagaacaaatgaataaatttgtagaagcagctcaaaacggggatttaatcgaaactcagaatatcaatgaacggattcctgaaatctgtttcgttaaagccgattggtgggatggtcgtttacttcaacgagttatcgtctgtgcagctaatcgttttaaattgaaagatggcggagagttagttattccagggactcgtcattattcaaaagatatggctctggtgttagaccaaatgcgtgataaagtagtttctgaacaggtttatggtgatgaccaagggttcttggaccaatggggaaattattttactcgaaaagaagcattaatcattgcaactcatgccggtcaaattaatactcgtcgtgttaaaagtgggcctgctgatacattattctccgaggatttatattaatgaaaatgaatattaagttgcttcaaattgaatctttgcgtagtcaaatcaacgctcttaaaaaagcaaatgagatgatgcatgaacaatggacttcattaacaaacgaatcaggttggtcttggttatcagaagctgttgtgaagaagctgacaattaataatgatccatggatgtggaatggaaccattaagccattgtttgcacaatattatgttatgcttaaccttgaaatgattaaagaacttgaacgccaaattaagaaactcgaggaacaagatgaacaatccagtagcaaagcatgatttcaacaaaggcggcgctcataaagatatgaagcgccaggaaaaagaatctcgtcgtaagcaaaagcataaaggaaagggctatgagaacatctgaaattaaaatggtaccttacgttacttataccagtgaaagacttcgtgagttccaggaccaatttaatggcactggcattttctatgatactctaagtgaaattgaaaatgatgtcaaatcagatattaatgacaatgattttatcattcgcatgtttttgaatggtacatttgaaatcgtagcaatttctgataaacgaattgaagatgctattgctcatattgacaatatcattgatgaaatgacggaaggatattatgaataatatttctcatactgaagccgaacgaaaagcatgggatgaacatactaatattgtagatgcaataactcccgtgtatcatctcgttgtatggttctctttgagccgagaagagcaagattgctcctggaaatattttgaagatacaacatttcaaaaatttgttaacgcagttaatcacccggaatctctgctcactcattgcgaaataaaagcaagtgaagaaacattttgttatttcactgtaagttctaagcgtagtattgctgatgtcatgcaaggttatcaattcctcaaaggtgttgctgacgaatttgaattgaaaatcaattacgagaaaatttaatgaaccagacagtagagattcaacgctatctcgaaggaatgatgaacaagcttgcacttggtgacatggtagattacagctatcaagaggccatggagatttgtcactggatgaaacgtagggttcgtgtagtaggagccgaatggtatatatcagctgagttgattgatggtcgctacgccattcgctatgactctggtgacgaatacgtaactttacctggccatgtacttcaacgctgggaagtggtgaactgaccgtttacattcaccgttgactgtgttactatatcctcaatccattaagtcgtaggaaatacttgatatgtctaaaattgaaattgttcgcgaaattgttactgtggcttctgtattgattaaatttggttctgaacacattcttgaaaaacgtgaacattttattgcatttttgaatgaaatcggaattaagaatgatttaggtcgtcctctaaatcagagtaacttccgtaaaatgattgaagaaatgacagctgaagaaaaacaacagctagttgaagagttcaatgaaggttttgaatcagtgtatcgttatatgatgatgtatagcaagccgtaacatccttgttacttggctcttcctaaagttcttgcagcttgtccacaaattgcagcaagcctgtcttcatttaagagtggtttgctataccagtacatggaaactgtcccggcatatacattgtccaggttgaaatacggacatgagtacatgtacttcaactccccatcctttttcttagtcggcaagaaaacaaattcattttcagaagagaaatatgcacctctcaaatgagcagaatattcgtttgaagtcttatcaactggaaatcctcccaaatttttttcattgactgcgctaggcagtcgcccttcatatgcaattaaatctacaaagtagtttaagttgcgtggtctaaacgagtaaattgcggaaaaatctgcattgctcgaaacgtgagctatctgtagttgttctagagctgatgcttcaaatttagcctctttatcttgttgcaggactttagtgtacgtctcgtaacgagactctttccacacttgcataatagaatctaaacgataccatgtaagtgaaagaatgaaaacaactacaagcgcaacaacccgggaagcaagtaccctcccggttgcgttatctttgaagagtctgtctagaacaccaaataaaatgtcagatattcctggtagtggtgttctctgggtcatataccctccttttcaagggtatttatgctttaaactcttgagccatagatgctaccaactttaatccaagttggagcatttccatatactgctgcaccaggttgtccaccgacatacccttctgcttggtcaccagctttgttaccgggagcaccggcgcgtccaacatcaccgcccgcaccaccatgagagccataacgagtatttggtggctgaggaccaggagccgctaatgtaccagcaataccgtttttagaatctcggccttcaccaagaccggctgggccaaatggacgaccacctgaaccaccagaagccaagtttttaccaacgcgagctccgccaccgccgccaccgccgccacaaatagctgcattattttctatgcgaagacgagtgccaaaactgtttaaaatacatgggccgccattttgaccaacgttaactccagcagtaccaccttgaccgcctcggccatagatattagcattaactcgtaaatgaacatattcatttggtaagttagatggaaattctaaacaaggaacaccagtattttgagcaaccaaatcacctgaaattacaacaaccgctggggtagaacccaatgcgcgaagtttattaatcaggtcgtttcggtcatagttgtggttagcgcctaaagttatagttatttctttagagcgtccaatcatagaagacatcataaatggaacactcattcttaagacagttcctgcttgggacatccattctttgcctgtctcgttttttagctgaactgccaaccatagggcctgttactgccatattaaatcctcaggggcgtaaagcccctcttaatttatttagattcaagttctttaattctagaattaagctctttgatactttctactaaaagtgctatggttgcggaactagagatagttttagttccatcagaaagttctgaaactgcttcaggaagtactttttctaattcttgcgcaatcaatccagcttcatgagagttgtactctgaatcatttaaagattgttttttatcatagacgtagccatttagcttttctactttatcagtagcactttctattttaactaaattagttttcaatcttatatcagaacgaattctaacatcgttgaaattaccattaccgctagcgtaaaaagtcccacctacctggaattgccaatctccaccatcgacacctaaattaattctaagcggattcgctccagcatctttatagatatatgcatctacacccctagaatccttaaatcttatatgtcgacgagcgtttttacttaattctatatcattataagtcctaacgttatcggcactaatccagttagtaactcttaatgcgccggtcatagtatcgccagacttagaaacgttttgaccgtgaacccaacttaaagcatcgccagcccattcagaaccaccaaaggatttccaacgcgagccttttaagttaccgtcatttgctaaacaagcgcctgcgttaccccaagaaatagcattatctgatgtactatttactgtaagacctgaagcatgagtcacaactaatggagtacctatagtaacttgcccggttgagttacttattgttaacggacgaagaccgttccatgtccccatttggtcgccggagtttgtcaacatgaaataagtattgccaccatcgttacggataaagaacccgtagttaccatatgcaatacggaagccatcactgtttttagatacgaattgagaaggaattccagttttcaaataatcttctgttacaacccggtcccatgggcgccatgcgtcagaactatatttcgcacgtaaatatacccgagtgctgttataaacatggtatctttgttgaacacccgcaccagaagtaactgttaaatgacctgcgagtgcttcaggatagttcaaagccaaagatgtgtttacattagagtgctgagcatattcaccagcatggtcagccccagctaacgtatctaagttcacattggcaccgagttgtaacaaattctgatagcgtgaatcgaagttactatagttagaaggctgaacttggccggtagatgatatgttgccagtaactgacaatccacctttacttatggctacgccattatccatgtcaaaatttgcacttccgcgaccgcgaaaataatgataatacttactacccgaattgtaaccaatcagagttacgccattaccaccggcattatttccgtctaatgaagtgtcaacttctaataacgcattattattaggagggaacaagttatccgagttattatcactatgtactattttagtactctttttaatataaaacggcttattagctgaagaatatatgtcaactattctctggttatttgacataatgctaatatcaccgtctttattccatttaaaaccggtgtcattatcaccaagtgcaatagatgaatcgcctaatcctgaatattctccaaaattgttagcaccgaccatcagagagccgctataaaaaccatggcctttagcaccacggcttgctaaagaatacattttattttcagggccagaacctgtgtaccaagagttttctgcgccggttctttcatctattaaatgatgccaaatcgtcgcagtggcgtgggcacgacctttgtatacatagttcagtgctaaagcaccattctggcctactgtataacccacaaggtcattccagccatatgactcattagtaccaaattggttccaagttcgatcacgagtataaagacgtccgccattaaacgtaggagcaacagcttcaattgccaaacgtgcacgttgacctaagaagtcacgaggaatattaaaatccccatcacctcgccaactgaataacgcttggcctgaatcagtcgcagtaccatttaatacacgaaggttaattgcgccggtatttgcttgttgaggaggtgcatacataacaccacgctcaaagtttttaccagtgcctacttcaataccttcaaaccataaatgggcattagatgcagcattagcccgcgtacgaaatacaccagagtttgctctgatatcaccttgtgattcaacaccagatgaaactaaaagtgttttagctgaaatatccccagaagtggtgtaattaccggtttgagtgtaattacctacttgagtaacgtcaccatcaattttaccacctttagcaaaaccgaggtcaataatttgtccatcagcgttctttgtaaataacgtggaatctttgatgttaattgctaattcgccttctgcgatatcagcgggaagcggtcttttaccagcaacattagaacgcttaaattgaatttgtttgatagttgccataaattcctcaataggttccaaaatcttgaatagaatctcttacgacaatctggtcaaaacgaggaacatgttgtggtgcagaagctgcgtttaaagaaattaaatttggagcagctaatggacctgtcattgtttgtaattcggttgtatttattttcacctgagcgtcattggtgacattacctaaaccaacatcaacattggtaggtttatttcctggtgaataaactcgtccagcttcatcatataaaaacttacctaagacatctcccatcacaataagacgaggcttagtcatatcagtaactgggtcaaaaattacaaacggtttgccttcaccggtttcaaacgcaaattgagcaggtactttaattgaagcagtataggttgctcctaatgttccagttgcttttcctattgtaacttcagcaccggcactatcaaggaaagtcattccttggttaaagttaactgtttgtagatatgttccgccatcagctttagaaacaaagtcgttatctacagcttgaggcttgtcgtattcggtatagactttataagtcttgtaaagcagagtatcgtttattggaaaaagagggaaattcccctggtgccaaatcggtaatccgccaattgtactgttagcttttaaatcagccatggccttccccttatgtgtttgttgtatttattcagaaacaacaaaagccccgaagggctttaatctgtgtattctctgaagtcagctgagtagatattaccagacttatcatcttcagtatcaggaaggactaatagagtattttcatttactccatcagaaatcatattattcatacgaataccattgacaccgaatccggctgggtccataagaggttcaaccaatcttgacacttgagtaagcatcatttctctaatggctccgcttccttcagaaccagctacttctggataacgagaagctatgatagtaaatccatcagcagtgtctggtacagtgacatatctttgatgccaggcccatttgtctgcatctaaaggatttgtttcgactacagctccagataaataagagcttcctttaaaccatcttaagttaactctaatattttgtccaggagcatttaaagaagcatcacctttaacttcaaagttccattgcattttatctccaggagaaattccatactcgcttattggagatatttgttcaaattgccgtggaaatcttttactagtattatctttattaatgatataagtttcaggctcatcaattgctttttgagaatatccagtagctcctatatcactaggtttatcataaatgaattcaagtgctggcctaatgtctctgtcttcttttttgaaatcagagtaagtagcattttcagcaattatctttttacgatttatagaatacaatgcgcaataattgcaactataattggtcgttaagaatatgcttggccataaaactgagccaattgatttcattaatgcttcaacagacgggcttgaatataatctatcgtatgaagtaattataagcaaattgtcagaagatactaatgttttcatatgattaacaaatgcttttgttccagcattggtgtcttcaggctttatattaaaagtcttgaagttaatcatttggttgttagttggattaaactctcttaaatttatgccgggaccgtcatattgaacaccagcaggttcatcctggaaagtataataagcttcagaaggggtagactgagctacccctgcagcgaatgctagcttatacttgacggaattgttctcagagagaacttgagtttggacaaatccttgtccaaagctcgccatcattttagccattattcatcaacccatatgaagtcaacagtgcgagtagtttcattaggaacaatacgaacgttcttaatctgtaaccaatcgcgaattgtcaagttattgaaagctgaaccagaagttgatacagcaccaatttcccctgcagtaggtctctgaactgaggtgtacatcttaccaaattcgtcccactcgccagtgacgatgttgaagttacgaatccagaaagtctgagcattgtggtttaactcttgcgcagttgggcgtggcgcccaaatttgatagaccgcagtcttaccaataccatgctgagttaatacaccaggacctttaacatattcgtaatggtctacgaaaccggtgtcttgtccttcagcatctttttccataactggaacaccatagccaggcaatttgttataaattgctgctgacgtaattgatgcagaccatgaagctgggttatcatctgatggtttaacatcaggagcaactcgtccttcaggaatctgaacagtcaatggagcttgaatttgaagtggcccagtcattgaatcacctgctttcttaacgaacccttgagccgttatttcaaaagcattcttggtattcagaatggtgtaagtgccagaagggtctacaactgagaatgtcttagcatctttgttctgcaatgttacttgcttagattgagtaccaatgacaatttcagtagaggaaggattgataaccattgtaccaccttcaactgaaaagcccttattagcgtcaactttgttcattgccgtcagagtctgagcaaccgttatgtttccattacgattaagcgtcagaactttatctgtagcagtaaaatcaagagttgaaccattcgccagagtttcaatgttccaaccattcgccagagtattcaaattgattctagaattacccagggtgtcaccaatatcaacagatatagtagcattcacggtagtgaatttggccgtactagaggacaccagaggagcttctagagtaacatcctttttgaatgtaattttgccattaactacttggtcgatatcgcggcgaacaaactgagttgaatcaattccatccagtaaatccgaatcaacagcttttgctttagccggcaagaagtattgcagagcacggttcatctcatatggagatactgcataaccttctttaggcaaatctgttaaagcgggttcgttaattaaatcacctggaagcagacgaccagaaccatttaaagtatcacccttaaaggtgagtgctttttctgataatttaacgaaaccacgctgagctatagtagattcccaagttttttcttcttggacaacatacttaaagttcttaggagaaactgctttattagcaatagtaccggctaccgtttcagcttggttagcaacttgaataataccttcggtagtttcagtagctttcttagcatgcaatttcttaggcgtaacaatcgtcttatcatcagtaccagcatcaacttgtacctgagtggccagagcagcagtaccacgctgagtctcagatgcttctttgatatctaatgtataatggtcccacaaggttccttgctcaactaatccagacagagcaacaacagatgttctatcggttgaattgaaacgagttttaacctttaatggagttacgatacgtgtatcgtccattccggtatcaaattcaacttgagttgcaatttcagcaataccacttaaatcttcacgagccttacggtcattcagagttttaggagtaacagctttattgtaattagtaccagcatctacttcagtttgtttagcaatctgaataagaccaattcttccgtcagtagttgttttaccatgaagagtttcaggagtaactacaacagggaaaccaggctgtgccggaccaccggcaattacttcattttgagttgcaagataaacaccgccctgagcttgctcagtagacttgaattggaacaacgattttggagttaccgcatcaatgttgttatcataatcataaacgttagtacctttagtatcacgtccaatacccgcaagagttccagtcgttctgactaatttaagaataccagtcaaaatctcagaagcaatacggttatgcagcttcttcggagtgatgatacgttcatcgtcggttgaaccatttgcttcagcttgagtagcagtttcagcaacaccacgacgagtttctgttgctgttttttcattcagcatcgcaggagtgacaataacatcatccaaatgcggtccaggagttagagcttggatttcagttaaagtaactaaacgagcaataccgcgacgaactttagtagcaacacggtttgccagagtttgaggagtaattgctaactctttttctggattattttcgtggtcaacgtttgcttggtcttgacttgctaatgcaataacacctaagcgtttacgagtttcgttatctttagagtcaacacgctctacggtcggatcattatcagcaacaatccagtatttacttccagcatgttcaatataagataattgcaatactggaacataagaagtagtaccgtcaaaagtaagaacatcattcattacccaagtggtatcaggcggatactctgagcgtttagggaattgcagtaattgaagacttgaagcaattttatctccagtagctgctctgatatttactttctgtcctttgcgcatataattcattgcaatagtgacagtatcgccaatagcaatatcagtaggtaaagttatatcaatagttttctgagtgctgttatttacaccaaaaacagtaacaacctcgtttggaattaaagttacgttgtcggtgatcacacgcatgcgcggacgtaagtcgccttcccagattctccagattgactctgattcatcatatacgatgaatccgtcaccagaagtacgaacttctacagatttttgaccaacagtaccgatattggtgttatcatcgaaagtactaacaatcatatggaattgagggttctttccatcaaggtcagtaaagttgatgatatctccagtgtttgcatgtttaggcaaagtaacacggattgggtctggagaagtatatctgcgaactataaagtcgttagattgagcttgaacaactgcgcttggtgttacaatacgagcaactcgttcgtaatcagaaacgtaaagattccacaatctattgctgaacacaaacacatattgagacagcggatgagtcattttgactgagcgaactttattcgtagggccacgcaacacaatgtcttgaatagatgcgttgatagttacaccaacggtaccggttttattaccgatatccttcagcataattgtatcaccatcttgcggattatttggtaaagtgaaaatcatgtcattaccttttgcggtatcgacagaaataaattcacctgattttaaaattgttgttccgcttgaaactacacgccattttgcgtcggtacgaaccgaagtccaataaagctcattaaaattgccagcaggttttgcaatatcacgatttgaaacccaaatgcggttgtcgtaaattactgcgaaaccggaagtgtaaccacgagtagaatcatactgttgtaatgtgttttcttggataaggaattcaacgttgacgccatcggataacaccgtgcggtcagcagtagcaacgttgactattttttcacccgcagcatcgaagccgtcagcgccacgaaacttgcgtttgattgaatctgccataatggtgctcctatttgctattatagaacttatttataatgactctgttactaaatgaacgaggttctaatgtctaatttaaactgtctgttcgacgaagaagaccaagtaaaagatggttacattctagtcgacttgtctcaaatcgcattggcgacggcgatgcacaccttcaaagataaagagaaaatcactactccgatgcttcgtcatctggtattgagcactctgaaatttaacgcattcaaattccgtaaagatggttacaacaaggtgattatttgttgtgataatgctaagtccggttattggcgtcgtgataaagcttattactacaaaaagaaccgtgcagatggccgcgaagaatctgaatgggactgggaaggttacttcgaaggtattcgtactgtaatcgaagaatttgaaaagtacatgccttatcatatgatgaatattgataaaatggaagcggatgaccatattgcggtcctcactaaaaagctttcgttagaaggtaataaagtacttatcgtttcatcggatggtgactttactcagttgcacaaatatccgaatgtaactcagtggtctccaatgcagaagaaattcgttaaagcgaaaacaggttctcctgcacttgactgcatgatgaaagtagttaaaggcgataagaaagataacgttgcagcaattactgtacgttctgatttctggtatactcgtgtagatggtgaacgtactccacctactaaaactgcttttgttgaacagtgttgtgacgctgaagatatcaccacaattcttgaaggtgagcagctcaaacgtttctatgaaaaccgagtgcttattgacttcgattatattccagaagatattgctaatcaaattctgaattattataactcttataaagtacctccacgtggtaaaatctatccttacttcgtgaaatcaggactttcaaaattaaccaaaaacgttaacgatttctgaggaaattatggctaaagaaaagaaagaaccagttgaatttgacgaagcagtgcatggtgctgacctcaagaaactaattgttgaagctgctgaccataaactgaaaatctccggtttccaggtcttaatcaaagacattcgagaccgtgccaaagatgaacttggcgttgacggtaagatgtttaaccgactgctgactctgtacttcaaatctgctcgtgatgaatttgaagccgaaactgaagaggcgattgagctgtatgacactgttttccctaaatgatgaaactccggctgaaaagccggattctgttactacattagtagataaacagaacaacggcttcgctatcgaagctttagttaatgaacatggaatgagttatcttgaagctgctacacactggttagaagaaaattctttccctgaaactgcattcgctaaatatattcctggtaatataattgaaaagattatgagcgaagcattggacgataatctattgcgtccatcctttagtaaacagcaaaagacaaatacactcgatttcctgttatgattaaattgcgcatgccgccaaatggtggacgatatatcgacggtaagtctgtgtacaagttgtacttgatgttgaagaatcacttcaatggtcgatatgatgttgtcaagtacaactggtgcatgcgagtatcagataaggcttacgataaacgtcgtgacaaatacttcttcaagaagttatctgagaagtacacattaaaagaattgaccttgatattcatcagtaacctggtagctaaccaggacgcttggattggtgaaatttccgatgcagatgcgttagtgttttatcgtgaatatatcggtaagctgaaattaatcaagtcgaacttcgaagaagacgttcgcaatatttactatttcagcaagaaagttgaagttaaatcgcttaatgagttatttgattataatgataaggttaactcgtcatacatattcaaattacttcaaagtaatatcatctctttcgagacttttataattctggactcgtttctggacattataaataaacatgaccaagcaaccgataatcttgtctggtcaaactactctacaaagttacatgcgtatcgaaagatacttaatgttgaccgcgaagaagcaaaacaactgttcataaaaactgtcaaaaactgtaaatattaaggtaaaatctatgtttaagcgtaaaaatcctgctgccctggcttcccaactggcttccctgtctggttctaaaggtttcaattccgaagataaaggtgaatggaaactgaagttggataatgctggtaacggtcaagcggtcatccgtttcctgccaggtaaaggtgatgaaggcgtaccattcgctgttctggtgaatcacggcttcaagaaaggcggtaaatggtacattgaaaactgtacttctacccacggtgattatgattcttgcccagtatgtcaatatctgtccaagaatgactcatataacaccaacaacgaagaatacaagctgttgaaacgcaaaacttcttactacgcgaacatcctggttgttaaagacccggctgctccagaaaacgaaggtaaagtcttcaaatatcgtttcggtaagaaaatttgggacaaaatcaatgcaatggttgccgttgacgttgaaatgggcgaaactccaatcgacgtaacttgtgcgtttgaaggtgctaacttcgttctgaaagttaagaaagtatctggtttcagcaactatgatgaatccaagttccttggccaatctgagattcctaacatcgaagatgaagcttatcaagcacagctgcaggaacaaatggttgacctgtctactctgactgcgaaagaccagttcaaatctttcgaagataaccagaagaaattccttcaggttatgggtacagctgctatgggtactgccgcgtctcgcgcttctgctcaggctgataaggttggtgaagacctggacaactttgaagatgacctcgcgaactttaacgcaggttctcagaaatcagcaccagctgaagacttcatggaaactggcggttctgcctccagcggtgatgaagacctcgacgaactgctgaacggtctgtaataaaagaaggagccttcgggctccttttgttgtttctggaatcgtaacttatacgttacattaacctcccaattcccacctaaagtaacttatacgttacgttaattctgctgtttacatccgctttaagctgtgttactatactcttacaccaaccaaacggagtaaaacaaaatggcacatatctatctcggcgttgcagatgaagaacatttcgaagctgaagttgaaaaattcggtcttaactgtgaattagcaggtgatgtagaatggggatatgaatacaaagtattcggtcctcgtgagaaaattgtaaaattcttaactgaatcttactgtgtaggcgctgacgaaactggcgaattcttggctgacactatttctgaaatttgcaactaaccgtttacatcaccacatggatgtggtattatagcactatcaaaacaacaaagagtaaattatgaaacagcttgtaattgatatcgtatgcgaactcgttaaagaaaatggcaaagtagttgatttacagtttgatgacggctctcgtttcaatagcccgtttagcggtttgaaatttgaagttgtaaatgaaagtggtcaaggcggcggatggccagaaattaaattaattggtcatcaagtagacatcggtctttgggttaagaatttttatgcccaagacgaagaagattatgagtacatcatggaaatgatggaagattacaccgcttaataatggggccttcgggccctttggagattgaaatgttttatgttctttctgaagattatagctatgatggcagcaaaaacatctgggctggcaacaacttggtacagctgtttgacaaagcttctactccaaaatgcatgaaactcgttgaagacgagtgttatgacatggtggttgaagtcttctcccttgaaggcaagatggttaagcatgtgtatcttgaatccaaacacatgaaatcatttgatgctttcaaaaagttgctaaaagtagacgattaaccgtttacagcagggttatggtgtgttactatagccctatcaaaacaaaggagaacaaaatgaaacttcaacgtcaatcaattaaactcggaagcgaatacaatggcaagtggtactttatcatcgaagggaatgacccggaagctattgaagctgctgaagaccgccttcgcgaaatggaaactggtgctgttcgtggtgatggtctggtacttacttgggaccattactgcgatggctgtccctgctatgacgatggctttggtagcggtttttggattgaaatttctgaagtcgaagctttcaaagctgcctggaaaattgctaaaaaggagccaaaataatgtctaacgatattcactcaattgcatatcctaaagttaaagtacgttgtcagtttgagaattttcctggtgtgtcttggattactatggagtttgacccacactcccgtggtaaccgagtgtcaggcataattgaaaccggctatggcaccttcccgctggatgaccaaatcatcaacggttatcttcaacgccagaaagtaggtgcggctttcatcttcactaaagcagcatttgaagaactcgctggtgctgttgaagatggaatggaaatgatgcgtcgtcttgtaagggctgctggttatgattcgaattctttctgattgggaatgcaagtattgcggtgccgggttgtggtcacttggcggtaaatgctttaaatgtggaatgaggcaggggtaatgattcaattaatttatgcttattgtggaaccaagaccgttgatggtcaaaatgaatatgcttttggtcttaaagacggtctgccttggggtcatatcaagcgtgacatgcaaaactttgcaaaacgcacaaaagacactgtcgtcatcatgggtgctaaaacctggatgagtatgccaacatccttaaaaggccgcaagtgtattgttatccaagaccttaatcgtcactttgttcaagcgaaggatggtttatttgctgatggctacatgagtccagaagaattcaaagctttccttgataaaacgaattgctattattctaacatcaacggtgaccgtattcgttttcttcctaatgacgactattcagttattggtggcaaggggattctagagacggctcagccgtatgcagaccgtatagtccaaacgtcaatacagaagaagcatcgtgttaactctgatgtcactctggacatgagcttcatttcatacccggcttgggaaaatgcattccaaatggtagaaacctcctgggtacgttgtgatgaactcacttcattgacggagacggtctatgaaagggtataatcttcgtctgctagagacgtacaaaactcaaaagaaatggaaaaactggaacaaagttcacggtgtgtatgagttatcctttgcgattgaagatatcagagagtatcgtaatgcagagtacactatctatgatagcaatggaaataacccaattgaactttgtcgttcaatgaaatcagtactacttgcttcaatgaatggtaatgttagcttttcaaatggctatgttacaatgattggagacttctttaaaagtggaagtcaggtattcttcaatcctttggaagaacaatatgaaaatcaataatcatttgacattactacaagaagaggcccagaaaaactgggctttagtaatcgagggtaatgctcctactattgagcaatataagcgaaagcctgagttatacaaaacaattcctcatggcttgtatcgtattgatgtagaaatcaatgacacttgggcagctgatgaaggcatcagaattgctcgcggattaggtgttaaaattatgatgaacactcgtcaaacaattcatcatattgctaaaggtaatgtagtcatcactggtaatacgatgactgtttttggtcggtttgataaacaaggccgtgaaatcttctttcgcccaggaaaataatgaaacaatatcaacagctaattcagcatatctttgatgaaggttacgtgactgatgaccgcacaggaactggcacttgtgctgtgtttggcactcagcttcgttttgatttgcaacaaggttttccagcagtaactactaagaagcttgcctggaaagcatgtattgcagaacttttgtggttcctatctggttcaacaaatgtaaacgatttacgtcttcgtcagcatggttctccgacaaatggtaaaactgtctgggatgacaattacgaaaatcaagctcgttcaatgggatacgttgatggtgagcttggtcctgtctacggtaagcaatggcgagactttatgggtgttgaccaattgactttggttattgaccgaattaaagaactgcctaatgaccgtcgtcaaattgtgactgcctggaaccctctagacatccctaagatggcgcttccaccatgccatatgatatatcagttcaacgtacgcaatgggtttctggacctccagtggtaccagaggtcggtagatgtattccttggtctaccattcaatattgcgtcgtatgctgctttgattcatatcgtagctaaaatgactggcttaaaacctggtcatttggtatttactggcggcaacactcacatttattcaaatcatattgagcagtgcgaagaaattcttcgtcgagagccaaaagaactctgcaatcttgaaattgattttccaaatgagtttgagcgctggcaaacttcatctcaactcaagtggataaaccgatttgctgttatcgaagatttcaagttagttaactatgaaagtcacccaacaatcaaaggaaaaatggctgtatgattactaaatttacaaatgctttgggaagtatcgtttatgctcaaactgatgagcaactgtgcgatgctgacttcaaattaaactcttctattatgattaatggctattttcatatagttctggctcatcacattgaaattgttggtgaatctactgaacgcgttgttattgtgagtaaagcataatgccacatcttagaattgtaattcaaaataatgaagaagaccctatcgcagaagtttataacatacgtgattctgaaattccaaaggtcggttcaattattcaagttcgtggagcgcgtctctatgttcgtaacgttgtccatgcatacgaaaaagcgcacggttttgaagaattcggacttgaatctaatcaattaattcatgatacatggtttattgtggaagttaaatgagagcttgtcgagtggttaataaataccattccgatttcgacgttaatatccaacgaggtacaatgtggggtaatgacgttggtaaaaatgctggcagccgggaggctgccattgaagcctttaaagaggacttcattaagcgtattaggagtggtgaaataaaacgtgagcacctggagactctccgtggaatgagattaggatgcacttgtaaacctaaagcttgccatggtgatataatagctcatatagtaaacagactattcaaagacacatttacgctagaggatttgcatgaaagtaattaagtccagtggtacctctcaggaatttattccagaaaaacttatcaaagttctggaatggggttgtgaaaacacccgagttgacccatatgagctatatcaagctatcgttccgcatctgcaagatggaatgacaacttatgacattcaacgcgcagctactaaggttgcagcttcaatgatttcaattgaagaaccagattatcaatatgtagcaagtaatctggcgatgttcaatcttcgtaagcaagtttatggacagtttgagcctcgttcatttattgaccagatttcatttggtgttaatcacaacaaatacgacaaagaaattcttgccaaatggtctgctgaagaaattgctctgcttgaaagtaaaattgttcatgaccgtgattttgaaatgacgtatgctggtacaatgcagctcattgaaaaatacctggtcaaagaccgcagcactggtcaaatcatcgaaactcctcaatttgcgttcatgctcattggtatgactctacatcaggatgatggtgaaaaccgtttagttaacactattcgtttttatgatgctgtgtcaactaagaaaatttctctgcctactcctattatggcaggtgctcgtactcctactcgtcaattcagttcttgcgttgttattgaagctggtgattcgctgaaatcaattaacaaatctgctgaatcaattgtagagtacatctctaaacgtgctggtatcggcattaacgcaggtatgattcgtgcagaaggttcaaaaatcggcttcggagaagtcaagcatactggagttattcctttctggaaacacatccaaacagcagttaaatcttgttcccagggcggagttcgcggcggcgcggcgacattgtactatccaatctggcacttggaagttgaaaacctccttgtactcaagaacaacaaaggcgtagatgaaaaccgaattcgtcacttggactacggtgttcaaatcaacgacctgatgtttgaacgtctgattaaagatgattacatcactctgttctctccggacattgatgctggtcgcctttatgagaactatttcaaagatgctgctgcgttccgtgaacaatatgaagctcttgaaaagaaccctgatgttcgtaagaagcgtgtcaaagctcgtgaactgattgagttattcttaactgagcgttcaggcacagctcgaatttacccttacttcgtagataacgttggtaattatggtccttttattcgtgatgtggctacgattaagcaatcgaacctctgcgcagaaattgcgttacctactaaagacgtctactcagaagacgcagaaattgcgctgtgtacgttgtctgcgttcgtgctcggcaacttcgattggcaagaccaagaaactattaacgagctcgcagaagtccaagtccgagcactcgacaacctcttgagttatcaaggttatccggttaaagaagctttgaaagctcttaaacgtcgagcattgggtgttggtgtaacgaactacgctgcttggttagcagataactttgctacatacgctgatgcaaatgacttgactcatgaactgtttgaaaggctgcaatatgcactcatcaaagcatcaattaaacttgcaaaagaaaaaggaccttgcgagtattataaagacactcgttggtctcgaggcgaattacctatcgactggtacaataagagaattgaccagctcgcggccccgaattacgtttgtgactgggaagcactccgtgcagaactcaagcaatatggcatccgtaacagtacattgtccgcactcatgccatgtgagtcctcctcccaggtttccaacagcacaaacggtattgagccgccacgaggtccagtctctattaaagagtctaaagaaggaagcttcaaccaagtagttccgaacgttgaactgaacgctgacctctatgattatgcatggaaacttgctaagcagggtaacaaaccttatctgactcaagtagctattatgttgaagtgggtatgtcaatctgcatcagctaatacttactatgaccctcagaactatgagaaaggtaaagtgccaatgtctgttatgatggacgacttgctttacttctggtactttggcggtaagacattgtactatcataacactcgtgatggttccggtaacgatgatttcgaaatagagaaaccaaaagccgaagattgttctgcatgtaagctttaattctttcagtttataattggaccacggatggtccaaatgaggaggatttatgaagcaaactatgagtattcaagaacttttggaaatagttaaaacaatagagttgacgcctgaattcattgaaaaattaagaaaacgtcttaaaaagctagacgaagagtttagaatttattcagaatcaactaaagttacatcagaattacttaataggacatacaatttatgagccacagaacagaagcaaaatggtacgacatttatgccgtttataataatggcgaacgaatgaaaacattcatcattcgttctgcattaaacgaagttccacctttaatggtaaacgacgacgatcacagtcttgcaatgtttcttgaaggttatcgttgcgcagctgaagctattgctcaggtgaatgttgaatttgaatttgaggaagttaaatgagcacagtttttaatacgcaacaagtagatttgatgaccgagccaatgttctttggaagtgggcttggtattgcacgatatgatattcagcgccaccgtacatttgaagaactgattgagaaacaactctcgttcttctggcgtcctgaagaagttaacctgatgactgaccgagctcaatttgaaaagcttccagttggccagcaaaacgtattccttgataatctgaaatatcaaagccttctggattcaatccaaggccgagctccagctgctgttctttctgctctgatttctgacccatcactcgatacatggaaccagacctggacgttctctgaaacgattcactctcgttcatatactcacatcatgcgtaacctgctgaatgacccggcaaaggtgtttgatgagattgttctcgatgaagcaattatgaaacgagctgaaacgattggtcgttattatgatgatgttatctacaaaactcgtcagtgggaaaacgccaaaaccgaggtttcttactggaaatttgaagcatgtcagtatatagctgacggtgaagaagtagatgatagcgtgcttagcgaacttgataaagctgaacagtgggaacgctctactaaacgtgctctgatgaaagcactttatctgtgcctgcatgtcatcaatggtcttgaagcaattcgtttctatgtatctttcgcttgtaccttcaatttccataagaacatggaaatcatggaaggtaactccaagattatgaagttcattgcacgcgatgaacagcttcatctgaaaggcacgcagtacattattcgtcagcttcaacttggtactgatggcgaagaatgggttcagattgctcgtgaatgcgaacaggaagcagttgatatcttcatggaaatcaaccgccaagaaaaagaatgggctgttcatctgtggcgtgatggtggagttcctggtctttcggtgaaaatccttcatgacttcattgactatctgactgtttcacgtatgcgtagctgcggtcttccatgcccgattactgacgctcctgttcgtcacccaatcccgtggattcgtgaatacttaaactcagatgcggtacaatctgctccacaagaagttgaaatctcaagttaccttgtagctcagattgacaacgatgtcgatgctgatgtgttgctgaaattcagaaagtatttgtaaggagagggcctttgggcccttctgttatgaaagatattgctaacgagttttcttttatagaatacactcaactgaagctgctacctgattgcactatagaccacgtccaagttccaaataagttgaatgtggtttatgcaattgcagttgatgatgagttggtctacatcggtaagaccaagaatctcagaaagagaataaattattacaggacagcgattaaccgcaaagaccagacgtcagattcaactaaatcagctaagatttatgatgctctgatgtcaggaaagactgttagcttctatgctcgacagtgctttaatctcctgataaacaatgaactcggtgaaatgtcaatctcaacgatggaccttgaagaaccgatgttcatcaaaaaattcaatcctccgtggaatactcaacataagggtaaaaagtgaaaaaattattcaatgagctcatggctctatgtaacgatgaaactcgtttcttctaccgtgatgatgtatctccaatggggtacaaatatcgcacgttttcttaccattacgcgtcttactctgactggctcctgccgtctgcattagagtgtcgtggcattatgtttgaacttgatgctgacgatgctccggtacgtattgcatctcgtccaatggaaaagttcttcaacttgaacgaaactccattcactatgaatctggacctttctaagattaagtatatgttagccaaagaagatggctccttggtttctacttatttggacggtgaaaatcgtattcgctttaagtctaagacttctatcaaatctgagcaggctgttgaagcttctgctatgctagcaagtatcgatcatctggatttggctgaagctctgattgatttggcaaaagacggattcactgctaacttcgaatactgctctccacagaatcgaatcgttctgagctatcataaaaagatgcttattcttttgaacgttcgtgaaaacgatactggtgaatacgtggattacgaagaccttctggctcatccagttcttcgtaagtatctggtagaagcatttgaagttcctgatggcgatttcgtatctaagattcgtgccgaagaacaaattgaaggctacgtttgtgtgatggaagatggtcttcgcttcaaactgaaaacagaatggtacacagctctccatcacacaaaggattctattatcaacaatgagcgtctgtttgaatgtatcgtgaacaacgcagcggatgaccttcgtggtatgttcgattctgacgagtttgcactgggtaaaatcaatgctttcgaagctcaatacttgaactatctgcgttcttctcttaaactgtgccaggacttctacgctacgcatcgtggtaaagatcgtaagacttatgcagcaaatgctcaagcggctactgccgcagcgggtctacctcagattttcggtatcatcatgaaaatgtatgcaggagaccttgacgacgaccagctcatcacgaagctgaacgctgcgttcttgaagaactctaagccgttcactccggctaagtacatctaaccgtttacatctccatttggttgtgttactatatctctacactaaccaaatggagaaaacgaaatgctgaacttaatcactgctgaagaactaatagaaatttacggtggcactcatcatgacgggattcgtattttcaaaaattctcgtcctctgggttacatcacagatttacgtgtagcttactctcgcgaccaaaagcggcaaaaggctcgtaaagaatatagtaaccgcgtaaatgaagaacgcgctgagaagatgcctgaagcagtagaagaaatgcgcagcttcttagataatcatctgaccaagtacggtgcagaagtgatgattaacatttcccaaccaaacgttcacgtaaatggttgtaagtgctacatcattgtagacccaatctatggaaagcatcgtctgggtgtttcaaatccacgtctgtccgcttcagaaatggcagagatggtggacccctgcttcaaaattcaaaactctcctgctgaacatcatattcttatcaatggtctttctcaggatgatattgtacaggcaatcatcaaattatgttcaaaataacaaacacacatgttattgtagtagcactaggactgacagcttatggatttatccaattccagtcaatgcgaatcgataacttaaaacttggactaaaagaagttcaagaagtagcagaagctcaaggtaaagctattgataagcttcagctagatatcaaaaatttgaatacgtacgatgaagtacgtaaagaaaacagagcggaggctgataaatccgatgctaaaatggctaaagatgctaaacgcgagcatgtggtcaaagctaagcctaagctggttgaaaagcagttaaatgagtctttcaacaaattgactctagagttccaggaggccaccaagtgaaactcttagtagccactgtattatcaattggactattggctggatgttcccagaatacaccagagttaccccagccaactgtagtgcatccatcttggcctgaccaaattaaaccttggaatgggcattggactatcgtcgaagttgatggccgtccgtttgtaggaatgccttattctgattctcaggagtttagaatttggttgaatgatgttcttcgttataccaaagatgctaatggtatgatatgttactatcgctctgaattaaaggaaccaaaatgcgtaaattcacactaggtgcaaagctgttttgttttggtttgttcatcgctgcagttgcatgcacaatagttcttgcaatggttgttgcgttttaattgaggccttcgggcctcatcggataataaaactttgaggaatatattatgcgctactttgtaaaagatggttcattcttatctgcaattaaaaagacccagttgcgcaaattgtgtatgcagggcgcccgtcacaaaactccattaatgcgtaaaaccactgtgagtccttggtttgaaattattaatggaaaaccaacagtagtttcagttagagtttttgctccaggaactgaaactatcccatctcacgtctttaaacttaaagaacaaacttatatttcagaagaaacttggttcaaaatctttgctcctatagaagattacgatgaatggtatggaatccgtatggaagaagattataaacgtgatttgattgataagcttattgaagctgcttcaatttacggacaagttaaatccaattgtgctaatggctttatctcagatgttgaaggcgcaatgcgtccagttggtaaagacgttcgtgaaatccgcaaatctttatatgaggcgcttggactatgaacaaatttgctaaaatggctctcgaaggagccatctctgaacttaaagctcgtgcaattgaatacggttcagcaaagactcgtatgcagcttgaagatggttatttgaattacgctgacaacgaatttgaaactgctcatgctaaagctcgatatgacgaagctaaagcgagagttaatgtcattattgaggaaattgctaatgcttaattctttattgtcaaaatatcgtttgcgtagtaaaatttatgcaaccgctcttcatatggaagatggctctgttactcacgctcaaatgatttctgatttagctgtagagttagatgaagcagctgatgaactacaaagttatattcttcctcgtcttgatgaaaagtatcatgaaattttgaatattttgatgatagaatatataagagcgcagaactggtatattggttcaaataaagcctatattgctaaatcaactagtcgtaattatgcgctatgtgtatactacgaaaacaaattcgatattgctcgtaaagctgtcgatgacttaatgattatggtgaaagaatgaaaaagattattttgactcgtggtgtaccaggttcaggaaaatcaacttgggctaatgaatatgttgctaaaaatcctggctggtacattctgtcacgtgacgacttccgtgaaaagctgtttggtcttgatgctcgtaatgcttacaaatattcaaagcataaagaacgtgctgtaacagctgctcaaatttctgctgcagtgtctctgcttgaccttgaacacaccaaaggtgttatcgtttgtgacactaacttgaaccctaaaactgttgagaaatgggaacttcgtttcaaaggtctgtatgaaatgtctttccaggacttccatgttccttggaccgaactcgttaagcgcaaccaatatcgtggagataaagcagttccgattgatgttctgcgccatttctatacactgatggaagttgagaaagtttacgttcctgatttgtctaagccaaaagcagttatctttgatctcgatggaacattggctgataaccatcatcgttcgccatttgacctcgataaatgtggtgaagatactccaaaagaaatggttattgaattgctgaaaatgcttcgtcagaaaggttttaaaattcttactgtgtctggacgcgaatctggcactaaagaagatgaaactgtttatcgtcgtatgactcagaaatgggtattagaccacgtcggtgaaactcatggacattggcaacgtaagcagggtgattctcgtaaagatgatatcgtaaaagaagaaatcttttggcgtgatattgctcctcattataacattaagcttgcagtagatgaccgagcgcaagtagttgaaatgtggcgtcgtatcggtgttgaatgctggcaagttgctcatggagatttctaatgggtaagcatgaatgctgggttatcattaatagcgatactggttgtgtagttgtatttgaaaaacagtattgcgcgtatatggatgaaggttcggcttgggaagtatgtttgaaagctcgtaaaaccaatccagagcgaaattttaccgtaaagagaactgaactctcccttccatggtatcgtcaataatgcataaggtgaaatgatgtataataaacacgaacaggttaaagaggaagcttacaagcttcttcgtgaaatcgtcggtatgaatatgacacctgagctcattaataagcttgctcaaattcgcaccgatatgaactctcgatacaaagatgagtattatgtagagttcgttccaattggtgaggttattactcactttgtcgttaacgttaaagtacacacggtgcactaatgggaattcatactgaagtacgtccaggtctttcaagttttcgtaaagtggctgaagttgttgtagctcaggttgcagacaattatctgtttgttccggcaacagcaccaacttatgcgcaaattcatgcagatatcgtaggtgctttacaaattctttggaagaatcttgaatttaaagttacgccatctttcaatagctattcaatgacttttgattttcgtttagacattgataaagatgaccctatcttcttctccgtaatttatagttgggacaatagtgacttctgataaaactttcacagtcttagaatttagacaaaaagttaaagattttgcacaagaagttgctaataaagttcctgggtctgaagttacgctcaggaacgatagagctactggcggagctttaattacaatcacccataatggaaaggaccaacatactttgcttacccttgaccgttatggacatgttacaatgactaacgttttaggtgatataatttgatgaatttaactgacatcttcgatggtgtccgaaaagaacattacaatgcttgtggtgacaagtctcaattcactgaagacggtgttggattcattcgttctgtgttagcgtgtgaccgtctggtgaattcttgcgccgagtatgatggaatccttatcacttctaaagaccaaacacctcctgtcgttggtgaacgtttttatggcgatgttttcttcgatggaaagaaacgctttaaagatggggtgtttataatcactggtacggtacaagagattattcctcttcatactgaaatcacattgattaaaactaaccgttcaaactatttggtgattcaataatgaaagctagcaccgtcttacaaatcgcttatctgatttcccaagaatcaaaatgctgctcctggaaagtcggtgcagttattgagaaaaatggtcgtatcatttctacaggatataatggttctcctgctggtggagttaactgttgcgaccatgccgaagataaagggtggttagttaagaaacccggaactggtcttcgtcaagatggtccaattccaaaatatggactgagcactaaattccgagctgagcattctgagtggtcgaaaattaacgaaatacatgctgagttgaatgctattctgttcgcagcacgtaatggttcttcaattgaaggcgctacgatgtacgttacactttcaccatgcccagactgtgccaaagctattgctcaatctggaattaagaaactcgtatattgtgaaacatacgataaaaatgtcgacggttgggataatatcctccgcgatgctggtattgagattcatcatgttcctaagacgaacttgaacaaactcaattggtataatgttgaaaactactgtggtgttgaaaatgcttgatttgaacaagcctcagattgtaaaagagccagaaaatatcacagattacgtagcacaacgcttacgtgaccttgatatttttactgtagaagttaaaggtcctgttttccaacttgaatcagcaggcggtgatatttcattagaaattgcatctcacatggctgatgatttggactatgctattaatgcaattatggaatacaatccaattgttgtattcatctatcaagttacaaaagaaccaaacggtaaatataaattccgtttacaatacctcgctgaacataaaggccattcaaatgactaagaaaactaaactgactgaagctgaaaaagtacaaattcgtgatactctgaaaccaattctggctcgtggcgaatctcaaatagtatttgagaaagtagacggtactatccgttctctgcgttgtactcgtgaccatgacatcattccaagcgacttggttgaaagcgttggctctcaggtgtctcgtaaagaatctactgaagctattccagtgtgggacactgaaaaacacgcatggcgttcattcaaactagattctatcgtttcagtaaatggcgtgaaggtagagcatctgctgaaactggttcaggttaaaggttaattgcttaaatatgagcatgataatattatttcatgctcaaacaacaaggtgtaacaatggatttaccaattaaagctatcggcgaacatgttatcttggtttctgaacctcctcagcaaggtgatgaaatcgtttcttctggcggtattgttatcggcaaacaagaaaccggacaaatccctgatatgtgtgaaatctattcaatcggcgcggatgttcctgaaggtattttcgaagtcggtatgttagtgccgctgccaactggtcagattcgtaatgtacctcatccgcttgtcgctgctggtatgaaaaaaccaaaagaaattgcacagaaatttgttacttgtcattggaagtcaattccgtgcatctacgggtgatataaataaaattgtgaagaacatgagaactacctccaaaaggacatgacatgttttcttctaagcgatgcatctcatctttaatgagtttgggctctgcatcaaatttttaacctcatttgaggaatgacattatgtcaatgaacaaacaacttgaacacgcgctgcatctgcagcgcaactcctggaacgcaggtcacgataactacggtgcatcaatcgacgtttacgccgaagcactggaagttctgaaaggtttcaaacatctgaatcctgttcaggcagacctccgcgatgtacttgctctgaaagatgagctgaagtttgctaaacctctgtgttcagcagctcgtaaagcggttcgtcatttcgtagtgactctgaaataagtacccttcgaggacttggtcgtggttggtagttatccagacgttaaatatccaaaactgctaaaacatgagaggtgtaagacctctcaattattaccctccttatatggaagactaaaaaatggctaaacaagctaaagcaaaaactgcagtaaaagaagttgttggtacctctaaacgcgctggctacaagcgtgggtctaactctcgtattaatccattggctgaccagctagcatctcgcgctcgcaaagttattgctcatgatgctgcatttggtaatccacgtaagaaagcataaagcataagttcgggactccttcgggagtcccttttttgtatccagaggttcatatgtttaaacgtaaatttattttcaaagttatatcagaataccctgcagaatattcacatatggattcagtctttttctatgaaaagattgctacactttggccatgggaagacccaattgaagttggaaactcaatgctagaatcattgccagcattcggcatttgggcagatgctgaataccatagttgcgaaaaactctaaccgtttacatctgccaaaagttgtgttatgatagaatctcaataaccaatatggtaatggagaataaaatgaacacaattaatctgaatgctactatcaaaacgaaagaccatgacggatataaagcaattgaagtagaagagccaatgtggcatctgtcttcgtggcaaggagatgtagttcactgcatgactcctgacggtccatctactgatttctgctggtacattgttctgactaactggttcaccggcactgaatacgttttgaaaacaagcattcatggtcatattcgttctgaaacttatgaagacgaagatggttattctgaagatgtagtgtggtatgaaaatggacgcactcgtgcagataacttgattgagaaaatgaagaaaactggtacagttaatcttgataactggaccgaacgtaaaatgttctaggccttcgggccttatgaggaaactatgaaaagtgatgttctgtaccgcttaaacaaagaaggttttttaaagttcgctgaaggatgcaatcagcgagtaaatcaattgattgccgattatatcggtgacagacctttttacattgcaaagggtgaagcaattgcttcaggttctattggtcttatccgatttgaaaatgaaggctggataagtccaaatggtgctgatattgatggtatgaatggcgattcatgtccttggtttacttcaaatgaagttaaaaattttctagttgaaactgaagaaaagaccgttgaagtgatgtatgcggctttaggccagactaagaaagaaaacgtttggttgaatctggaccaagtaggggatgctcgttccatagctacacttatgacgtcagaagaagctcatgacgcatgtaagtcgttcttgcgtaaaaacattgaaggtaaagctgtcattatgaagatgattgcaactgctaaaaccgagcaagttcctcaaacaattttcacagaagtgaactaaaccgtttacatcctccgttgtatgtgttagtatataaactcaataaacaaacagatacaacggagaacaaaatggattacactaactttactaagaaatacgttcaagataacgcatgggacgtttcaacaactttactctgggaacataaaaatggcacagttgctcaaatcgatatgtactgggaagataactacgtcttcatcagttttgaaaatggcccaactttagatgttaaactcaaaggttcagtcatttctgttggttttcatgatgaccaccgtaaacgcgatttaggaactcatccttcttggaacggagacaatcgcaaacttctggttaaactttatctgcgtcatgttcttggtcagaaaacaactgaagaacaacgtgaagcaatttgggatatcgtttcaaacgaattcgtaatctaaatttagggccttcgggcccttcacttgaggaaatatttatgagtataattggaaaaactttcaagttaactggaactgctatcaaagattatgcttctcgtcagtcgtgctttggtgatgcaattcttaaacttactgacaacggaaaaattccgttcgttgtaaaatctcttgataaagacggttgcataacagctattgatattaacggttctcttcatcagtctggattgggttcatttgacacagtatggtgtatcattatgtctcaagagatttcacggtaccttgaagaagttaaaccaacagagtctgatgcaaaagatttctggatgatgactatttcaactaatcgctcgcaacagcctttctgtgttggtccttacactgaagaggaagctaacgaaaaagctcaaaagcaaattcgtaatgcagttgaaggtgttcgtgttctggttgttaaacaagttgctgaagctaaagttaaaactgtattggagactctgtaatgattatcactattcctcgtaataaagcacctgaatttgaacgcggcatgttgagcaatccaatgattgaagtgctgggcgtaactgtctctgatacagaagtcaagtatcagcttgaatgccctgatttctttcatcaaattccaacttatgcggtggcagaatgaaataccacattttacaacccgtacagctgcgcaaaggcggtattccgggagtcatctgtgatactgctgaatcaattcaagaatatggggttcaacccgcttatgaagtacaatgggttgacgggaatactgatattcgtttagaatgtgaaatcgaacctcttaaagctgctaatgacgaagtttatgaaacagtttaatgtaagagggttaacgaaggaccttctggaatacgcaagaacattagccatatgtatatacagaattggtccttcaagtcagcctgggttcatagagataactctaagtggcccagctaacagtatcgcaacctttgagaaaatgttatgcaagtcaaatatgatatgaaaggtcttgatgttttaaaacgcttaaatcaaggcggtattaaagtaggagagttaactactctattaagtggagttggacaaccatcactgccgggtaaatcttgtatcgcggcttacatgattgctaaaatgaaggctaaaaatgtcaaataaaccaattatctctactgatgtagatggtgtattagtaaagtggcaatcaggcttgccttacttcgctcagaagtacaatctgcctgttcaccatattcttgaaatgattattgatgaccaattcgttgcgccaaaagatctgtttggtgtagacgaagaatttgctcaacagctgatggtcaaatataattgctcagatttcattcgctatctggcagcatacgacgatgctctgaaagttgtcaatgctctgaaagataaatatgacttcgttgcggttactgcgcttggtacttctgttgatgctaaactgaatcgtcaattcaatttgaatgctctgttcccaggtgctttccttgaaactttcatctgtgaccatgctgagccaaagactaaactctttgagaaaatcaaagaaaaatatggcgacagagttgttgcttatattgatgaccttcctcatcatgtagattcagcttatgaagtctttggcggtgaagtcaattgcatgtttatgcctcgtggtcagcgagacacctcctctaaatatggagaaaaggtgcataactgggaacatgttcagcgtctgatgaatcagcgcgaattccaggaaagccttggtgataagctgagcgacttattcaaaaaggttgaaaagactactccgaattggccatttgataagtttccagaatttccaaagaaatgggtaaatccaggtccttctgattataagccgtggtatgagcatccaggtaatcttcctgtttacaatccaggtgtaggatatggaattggaacgggcattgaatatctaaatcgtcagcctacagctaaaactactataggtaaagcatgattaacgtaattgaatggttcccgcaaacagacacaactaagcgtttggaaagtttcgcaaacaaagaagagttcttcaaggcgcgcaacattcatgctgataatcaaaagcaacgtgaaatgattgatgcaatgttcaatggcgcaatctacattactcgtaaaaatggtggagtactttaccaccgaactttggctgaactcattcgtgagtatcatggtcaatagctttacaaagggtatgatataattgtcatacccgctcgggacaataaacgaggtgaatatgattttagatattatcaatgaacttgcttcaatcggctctacaaaagaaaaagaagctatcattcgtcgtcataaagataatgagcttttgaagcgagtattcagaatgacttatgatggtaagctccagtattacatcaagaaatggccagaagccggagaacgcactcaaagctttggtctattaaaattagatgatgctttagatttcttggaatttaaattagctgctcgtgaaattacaggcaacgctgctattgctgaattggcaagttatattgcagacctaaatgaagctgatgtagaagtacttaagaaagttctacttcgtgatttgcgctgtggcgcatcccgtagtattgcgaataaagtatggaaaaatctaattcctgaacagcctcaaatgcttgcttcatcttacgatgaaaaaggcattaaaaagaacattaagttccctgcatttgcgcagctgaaggctgatggcgcacgagcatttgctgaaatccgtggtgatgaattagacgatgtaaaaattctgtctcgtgctggtaacgagtatcttggtttagatttgctgaaacaacagctcatcgaaatgactaaagaagctcgtgaacgccatcctggcggtgtaatgattgacggtgaactcgtttatcatgctatcgttgaacctgctggtccgttggacgatatctttggcgatttacccgagctgagtaaagctaaggaattcaaagaagaatcccgtacaatgtcaaacgggttggccaataaatctctgaaaggaactatctcagctaaagaagctgctggtatgaaattccaggtatgggattacgttccgttggatgttgtttattccgaaggtaaagaatctggatttgcgtatgatgttcgcttccgtgcattagaactgatggttaaaggttactctcagatgattctgattgagaaccacatcgttcataatcttgatgaagccaaggtcatttatcgcaaatatgttgatgaaggtcttgaaggtattatcctgaagaacattggtgctttctgggaaaacactcgttctaaaaacctttataagttcaaagaagttattacgattgaccttcgcattgttgatatctatgagcatagtaaacaaccaggcaaagccggtggtttttatcttgaatcagaatgtggtctgattaaagttaaagctggttcaggtcttaaagacaaaatttcagattggcacgagttagaccgtactcgcatttggctcaataaaaatgaatacatcggtggtattcttgaatccgaatgtaatggctggttagctgctgaaggtcggacggattatgtcaaactgttcttgcctattgcgattaaaatgcgtcgtgataaagatgtagcaaatacgttcgctgatatttggggcgatttccatgaggttactggtctatgaaattctatttagagattatcacaattgctcacccaggtgaaggctcaggacgagccgctaatgtaacacagagcttggtcgaattaccattccgcccgcaaggtgaagtagaatcatttacagatggtcgagtttcaggaatcaacaaacacgaggttattgctactcgtggtggcggaaaagttgaaatcttcaggaatattattgcagtctaagcccttcggggctttaattgtctataaatataagaaacaatagaggactcataatgaccgaatttcaattaaatgaggtttttgacgcggactcagaaatgcttccggtcactaatctttatccgaaaactaaaattccacagatttttgcaattgctgctccagaaggttcagtagctcttcgtatgtgttcttacactggcggtggcgacgttaacaagaacgttaaacctggcgataaaatgatgcatgctattgtgcttggtgtatctgaaaaaggtaccttggttaagctgaaaaatcttggtggtaatccattgggtgttatttctaccatgtttgacttagtatctcaaactgtgaagaaatacaaaatggatgcagtgatgttccgtattgctaaaagcaaaatgggtggacaagctcgagcagtgcagatgattatcaaccgtttggtaatgagtcgtctgggtggtcgttttgttatcctgaaagaactctatgattacgataagaagtacgtgtatgttcttattcatcgtaagaatgttgacctctcaaccgtccctggcatcccagagatatcaacagaagagttcaccaaggttgatactgatgttggtgatgtttacatcaacaataagtcaggtaaacaggtttctaaatcagaagcgttagcagctactatcgctcaagagaacgacaaacgtactgaccaatctgttattgctcgtgctaaggtatctcgtcgtcaagtagcagcaagtcaatctttaacttctgacattattcatgacccagaagaatttgaaaaatacgaagctactgctgccgaattcagtaaacccgcaacggcaaatcctattccagaagctcagcaattgaaggatgcagtagaatctaaagcggctaaagctcgttctgctcaattagcagctactggtgctattttccatttaaaatcgttaaccacgattaaattgagccaatctgaaaaatttgaacagagatttgtaaaagaacttgaatcaagaattggtaacgctccattaacttcagttcagagtatgcaggcgtatactcaaactcttttagactctttagaagaacgtaaacatgaagcaatggaacatatcatgactaaagttccacaataccttgagccaaaagataaagagcaaatggctaacaatctttggaacattgaacgtaccaaaatgattaaagcagctcttcaaggttatgctaaaaacgtttctgctactattgaagatattactcgtactcgtacgcctcttcaatatacaaatgcagaaaaacgaggcattaaagagtatgttggttccggttattcagacatcaacaatatgcttttgggtcgttatagagctgacaattacgatacactgtcttataaagaagttactactgctatcaaaaatttggacgatgcatttaaacgcggtgacagaattccagaaggacttaccttatggcgttcacagtcagttcgtaaaccaatttttgaagctatggttaagaacagagtattctatttcagaaactatgtttcaacatctttatctccaattatctttggcggttggaaaggtaaccaagcggttgcaatggcttctgataatactcgtgcagtattgaatcagccagataacagtgcagaaactgtcaagttagcttctatgacttatgctgaattaggtcttactgatgaggttcatgcagctaaagatgttcagcaagctgaaagcacaagagtcatgattggttgggctattactggtggcgagaaagttaacgtggtttatcctggcgacttaagtaatatgtcaggtgaaatggaagttattctgcctcgtggtaccatgttgaaagtcaacaacattgtagatgcttcttatagtgatggtctcgtgtacgacaatcagaaattcatccaaggcgaagtaatgactgctgaccaattagacgaagctgttgtttatgacggcgatgttctgatggaaactggtgaagtggtagaatacagtgacgaacctcagcctgaatcaagtccatttgattttgaaggatttgtgaagtccacaaagacatcggaaagcaacaagattcttgctctgttggcttcaatgattgatgttgaagacactccagagaagttcgttctttaaccgtttacacgcacatggaagtgtgttactatagacttacactaactgaggagaacatcatgaaatcgattctgcgtatgaatggccaagaaactgtagttgaaggtgtagttccagtatctgacgaattcaacaacatggtctttaacgagattcaaaagattgctaaaggaatggttgaaatggttccacttgcaccgttcggaattccagaagacaaatgcgaagggtatattgcttatactctgaatggtaaattcgatggtgaagttccgtttaaaatcactgtaactaacgttgagcaatcttctgaagttgttctaaatgctttcgtggtgttccgcaaataaaacaaagggagccaaaaggctcccttttttcataatccaagtatcttggaagtactattccacattccagtcttacgccctattgcattacccatctgagtaacacctccagcagcgcctcctaatctacttagtcttgacaccgatgggtccagactcatgtcatcagaaatatttccaatagaatgaacaagtctatcttcaacccaatcagcggctgcttgacggccaacagcacctacctgcataacacgataagcaaactgaacatcaaatacagcaatttggttgtcgccgtcccaagtaaattcgggtgaaccacatgaaactggaacacacccagtaaacatacacacagtatgaggtaatccattacgtgcatgtaagttaacttgaatatcagcttcaacatcgataggaagagctcttaatccagtgactgggtcttgtacagagttaacccagtcttgcattgctctccagttgcttgcttcagaatccattcggaaacttaatgtaagtggttccaattctcttccggtgatacgaatattcggagagttatgaagccaatctgtttcgtgtgacagtctgttatcaggaattttagctgaataaatcatcaatcctgatgttgggaaagccatattgaagaagtcaagtaaataagtaccaacttcaaattctcccaataaagattgaacaacacggtttgtcatcgcgccgataaggtacttagatacgcccgatttacgaactagttcttgggtacctgcagtgataattgatgtaattccttgcgtaaattcgccttgagataatccaagccagtctcctgagactggcaagttattataaagcattccaccgaattggtccagcaataattgagactttgcagatggagtcgttgcgaatacacaactaaacatatttgtacgttgaaaatcaacgttcattacttggttgttgaattcatctaaattaagcattagaaaccttctgcataaagtgatgccctgcttaatgtcaagatttcgcggaaagtaatttccagagtaaaagtgcttggcatattaggagcaattgctaaaccattgaattgaccattcggagttttatcaaagcgaatactctgaatctggcatggaccaaacaactcggttcttccatcaaatttagatgtcttaccaaagtttctgatgaaccataccgttgggttagttacaacaataacgttacttaagaatgaagtgatattttcaaacattgtgttgttcaaatcagctccatctggagttaatggagacagcagagttgttttgtaccactcatccaattggccttttaattctttagcgtaacttgaattgccagtttcgccatagctgaaataattaaagcactcgtatatctgaataattgaaactaaatcagctactgaacgaggagtcaaatcccaagtgaatacttttgttctgttatctgctccagcatacatgcttcgcgcagtattatagatttgctcgttattgtcggccatcagaccttgagtgactgaatctaatgcaccaaatactgctgtggatgcaatattactcaatactccagtagctgaattatttccacgagtaattaatgattcaccaacgtcattgaacttgtgagaagttgattcaacgtcagatttagaacgtggaagtaaaatattcgcaatcggagatttatcaacttggccgttatttttaattccgaggctattaagaatagaactcgctgatttactcaattgggattgacgcatattacgaaggtccggagatgttcttgaactcatatcatatgcggtaaaaagcaatccatttttataaaggtcatgaacacgaaggtctcctgcagcatcgttaccggcggcacgttgtgccgggtattgagctactatagtacttcttcgagttgacgaaatagaactttgaccggcagaggtcttttctccactgccgaaatctttatctagaatttctgtagctcttatagccatgattattccttagttaacaccagttgcaccaaatacgcctggagcattagtgctcgttacaggactaacagtatttatagttctactgttgttaatgacgttatttgtattgaacaagttagccgcagcagctccagcactagtacctaatgaagcctctttagccgctttattcttctcaatgctttcgacttttttaacatcctcagattgagacgatggagcaggctgaggttctttacctttgagcttatcatacttagcagtaacaatattcatgcgagcacttaattcttttttagttacaggagaattattcaagtcagtgtcgtttaactgcgtttgaagattagcatatgctttatcagctgattcaactgaacgtttatcgtcagggttgatttgttccatgtatttttcaaatctaacaatagcagcacgagcttcattccctttcttcagaacttgttccctttcttcaggtttcatctgacgaagtttttcattctgggattctctttcttcatctgtaacaaaatcagaaatgttagcatctccagttattttgttaacaatccaagttttaccttgagatactttatcgaagaagttttcgcctttttcaatcttagatgattgatacttagctaatgtgtcttggtcttctttagaaagagagttacccgttctttcttggaaaccttccaatgcagctccttcaacagataatgcagcatctcctaagccaggaataattgaaagaatagcagcagctacctttgacattccaagagaaataagttcactgaggttgtaaatgatttcagttacgcctttgacaattgcaaccgccaatccagaccagtctccagcttcccagaacttctgaatattttcaagtgttccaaatatagatgctaatgtgcttccccattcgccagcttcgctagagaacttatcgaaatccgaagtgaatttgtctgaccaatatttgaagtgcttcattatgacatcaatgccaagcacaatagagaacaacagtgcagctgttttagcagcttcaatcacagcagttacagtgtacttgaaaagcattccagctattctgtctgtaatgctcattgaagctttgaatccgctttttgtagctttaagcagattgctcagagtgtcagagtctttctttttacgttcctcatcagctccctttttagaatcactctctgggttctctggaacggtagggaagaacgcatcattagggttattggtattattgaccgggtccggaattaactcctgaagtaattctggtaaccctggtgtcactatatcaacaggtactgcatcttcaactacagacagtgatgtatctggaacagatatctgtggaagattcggagtgatagctgaaagacgttcatttaaaagttctgttagcttactgagcttatctgaaatcttgtttgatacttcagtctgctgcttaacagcttctgtagttctttcagatgcttcggcggttaattcagctccggctgtagtatcaattatgctttggtcaacgcgattcaaggcatcaataacttgattacctttatcctcaattacttcagacgtaagctcagcttgagtttgtaaatcatcaagctgagaagaaagaactgataaagattcggcttgagttgatgcagctttcgctgcatctctttcactacgaccctcttcaataaccttccgacgcatcgtcttcatgttttcggttttcattcaaaaattcctatgattttggcaactcctctgatgtcgccattagggccgcttactgctacggtacttgaaatgtcgtctgcccatttagttacaaatgctggcatcttcatgaagtcgacatcttcttttttaccgtctaccgtttcaaggcattttgaaagcatcttatcaacaccgccaaatccttcaaactgcttaggagctctgaatttgaaagtatgaccagcgaattgaaattctaatcgttgaacaattcttaaagttgaaaggtcatattcaaaatcatctttgactaccttacttttaatcttaccgttgaactcaagtaaatgaattgaaacgtaatcgatttcggctggtgttaaacctggatgaattgaattaatcaagagcgataaattctcttccggagatttaacttctttaagcatgttgtgatgcttcaatccaagcttaggaatttttatttccttctggttcacttgaattgttttcattggaagtattaggtttaaattcatttttcaccttaattggttctactggacttaagttctgtccgttagtaaacatgtataatgtagttattgactggttgttagaaacttcatgaataacttcatctacgtaaaagtttgtgcggaattggtttttagggtcaaagaagtttatcttttttcctggagtatattcaaagttaccaaccatagtgcacttagcataaccgtcatattgcgccattgttcctaatcgtaaagcttcttcatatgcattacgataagtcatttcagaatatgaacctgagcgagataccaaaaccgagttataaccatcgccagtaataattcgagggaattggttatccaagaagctgtgggcataaaatgtagcattagccattgggttacgcgtgaattgattagctttagtaagccactcgaaattataagcaaggtctgtgttcagttcattaatcatttggccaatttggcgaggttcaccaacaacaaccgggataggctcttgggcaatcataaacgcgtagtccatcatgttgatgccatagatatcttcccacacaaacacgaactggtcactttcaacagcaagagatatttctctaacccaagctaaatagtcttttaacgtactcgtccatggaactcgtggaacgtaagtgttaattgagtttatagctggagcaatatgaggagtgtcttggtaaattacaccaatcatctctttaattgactctccagcatcgttgaagaaacaacgactaaatttgaggttgataatctcatgcaccaatccaagctgaattgcaattatgttatcacctttagagtcaactgaaactgaaaagtgcttacaaccataaatgcgattcaatgttcttttactgtttgcattagctacagaaatctgaatgatttggtcaccattcattctggtatgcatatttttgttatcatagaattgcagcattccttcatttcttccataaagaccatcgcgcatagtgagtgtcgttacagttgctgctaattcaaggaaacggttatctaaccaagcatcgtaattttcatagagctttatgcttaagttaggaaaacctggacgttgtagtactgtcatttcttattgtccttctctactaacgaaagggcgatgcttcgctcgattggaatcatacccattatgctgttcaagtcgtatgaacttttaactagagtgtgattgatttgatagaagctaaaaatttcatctgggtttatcagaagcttaaagactgataaaatgtcttcatacacgtttgttctcaactcgcaacatttcatcttaagttcaaatctcatcggagttaattgagtgtaaatcttttcaaacgttgtgaagtcaattgcttctattacttggatttggttgtcttccgacatctctttccaaggataccattgattgttgtatttaattgctttaatgcaatcataaatcattgcagctttatcttcgtattccttttcagggaatttgaaagctattgtgattccagccacttcaatagtaggttcaaccaaatcctcttgactgatatcaaacagaacttgcttttgtttttcgcaagtcggacaagtgaaagctactggaatttttgttttaccgattgagccagtgaatactttcatgaacatatatggacgtaaagtctcagggtattcaccaaagtaatcagctaaaagttcttttataatcaccttctgttcttcgtaagttttatgttgcatatcgttacgaaccagaaggaaatctctgtaatcagctaccgtgaagggtttaaaacgatggaccccgtccggtagtacacaacgaattatattggccatagaggtctcctttattgaaatatttataaatagtccgtaaggagctaatatgaactacgattacaaatttgaagtccagattaatggctctgatattcaatgcagagcttttacgttagaagaatacaaagagctcatcgatggcaaaatcaatggaaacattgatgaagtagtaaaacggctgattaataattgtacatcagcgaaaaaccttaacaagcaagaatcagaacttctgctgattcagttatggtctcactcattaggtgaggttaatcatgagaacatctggatatgtccagaaggtcacgaaacattaacaccgattaactttacatctgcacaaatcgatgaaccagaggaactctggtatcctctagcgaattttaaacttaagcttcgttatccaaaattattcgatgataagaacatcgcacagatgattgctacatgtatagagtacatctatgtgaatggtgaaaccatttcaatcgaagatttgaatgacaaagaaatcgatgacctttactcagctatcactgaagaggatattatccgcatcaaaaatatgcttttaaagcctaccgtttatctagcagttcctgtgaaatgtcagaaatgcggagcaactcacgttgaagtgattaaaggccttaaagaattcttcaggtatctgtaatggcaaatataaatgacctttattcggatttggaccctgaacttaaaatggattggtccaaagacgtggcacgtgctcgtgggttacgagcaattaaaaactctcttttaggtattataacaacaagaaagggaagccgtccattcgaccctaactttgggtgtgatttacaagaccagcttttcgagaacatgactcctctgacagctgatacagtagaacgaaatatcatatctgctataagaaactatgaaccgcgagtccgtcgtctacaagtgaatgttactccggtttacgatgaccatacgcttatcgttgaagttcggttctctgtagttgacaacccggacgaccttgagcagattaagcttcagttggcaagctcaagccgtaactaatcgctttcatttcaagatgattataatggttttgagttccttgctagagtaacaaattgaacaaagaaaggtgattatgaagcttgaagatttacaggaagagttgaaacaagatttgattattgattcaactaaattgcagtatgaagcagctaataatccagttctttatggtaaatggttgacaaaattgtctgctattcgtaaagaaatgcttcgcatcgaggcttcgaagaagtccgcgttaaagcagaagttggattattacacaggcagaggcgatggtgacgagttcagcatggaccgttatgaaaagtccgaaatgaagactgttctgtctgctgataaagaagttcttcgtattgatacaagtttgcaatactggggaattttgttagagttttgtcgtgatgcgatggatgctattaagtctcgcggattttcaatcaagcacatcatcgatatgcgtaagtttgaagcaggcgactaataaatagaattgttaataactgaggagacaatcatgtctgaaaagatttgtgctgtctgtaagcaaccgattgattcggcgttggttgttgaaacagataaaggccctgttcatccaggtgcttgttataattatgcgattgaattgccggtaagcgaaagcgcagaagagcaattaaacgaaactcaacttttaatgtagcctagtgttttatgccacttgtggtttgcccctctttcgaggggcctttttattagaattcttcttccgactctgactcatcttcagattcaaattccattctttttcctgccaatgcatctcgaatagagatatcatcagtatctttcaggtcagcttctttaacacgctttttgtaataagcttccagttcttctaaaccttccaaagtctggcattgagcaatcttactcataaacgtatcgatagtagcttcgtaaatgacttcttcgaatgttttcataacttcctcaaatatcgatttgtttcattacgtaattgaatttttcgtctgcatatctctgaatgcgctccagcgcgtgctttaaagcatagttcaaatgaacgtatttcttcttggcatttgctgattttggtttaacacccatatcatcgatgatatcccatactgtagcaactgatttagaatcatgcttacgaagtacacgaccgatagtttgcagaacgataattttagacttaactggatgagctaaaataacatggtgaagattcttaacggaaataccagtagagaatacaccataagatgcaactacaataatccccgtaccactttcagccatcactttcaatgcgttacgaacttcagttgatacttcgcctgaaacgtaatacactttctcatgcccaagttctttaatcatttcaaacagctctttaccatgagcaacatgtttgaacatcaagaacgcgttttcatttcttttggccagttttacagctaaattagctacccatttgttacgacgttttgcgctggtaattaccttgatttcttcttggtaagttttacctttcattttagtggtgaattcgtctgggtaacgaaggaagattgagttaatttttaagtcagttacttggccatcttccataagctgagatgttgaaactggacagaagatttcaccgaacattccaacatactgcatcacgttagctttaccgtcttttaatgaaccagataagccgaacttaaacatgcaattatttaaaccagcaacgatagtagaaatagatttaccagtagccagatgacattcatcgttcatcatcatgccgaattggtgaaaccattcttttggttgtttaacggctgtctgccaagtggcaacataaatcattgcatctgaatcgcgctttgtgcctgaacgaataccaagacaatgctgtttgccaaacagacgataatcacagaagtcattaatcatctggtcaactaatgctgttgttggaacgatgattaaaattttaccttcgtagttctcaacataataacgagcaagtaagcactggattaaagatttaccagcagatgttggaaggttcaaaattcgacgacggtttactaaaccttcaaacacggcatctttctgataccagtgaggctcaatctttttactcccagagtaaatgttaagattaccaagccagtcatcaaaatctttacgagtaatttcttcagtctcaaaaatcttcggttcgaagtaaactgaataacccatgttgtttgcgaatttacggatttgtccgacgaggccgaacggtaacagacggtcatagttcagaagacgaatacgtccatcccaatgtccataacgatactttggattgaatttgtagccatcagcttcaaaactaaaatagtctcttagttcatggaatgtggattcatcacactcaataaacacatgactaaaatcatgaaattttacattgatatcgtgcattgccgattccttagttataaatacatttatatttatacacaacgaggctactatgttagataaagattatattgctgaaatcggtgcacttgagaaaaaagaagccaaagaaaagcttgccgagtacgctgaaaccttcggcatcaagctgaagaaaactaaagcctttgacaatatggtcgctgaccttgaagtcgaattggccaaacttgctaatgaacccatgccagagcagaatgacggtctttcaatctatgaccttattcaagctgacgacgaggccaaaggcactgctatttttaaagatgaggctaaagaagaagctcgtctattgattgattctgtatcttctgatgcgccacaagtgaaagtaactgatatcgaccctcattttggtaagccaatggactcggttaaaggcgttattcttgaagccccaatcggtgattccgtgattacagttgcagatgataaagttcatactattccagtgactgcaatcactcaagaaaagtttaatgaagaaattgttgagcttcccgaaaactttagtccaaacacgcaattgttaggtaagaatccaggatatgttactcttccttggtggatttaccaatggattaaagataatccggattggaaatctcgcccaacatcgtttggacacccatcagctcaccaaacgttatttagcttaatttattacattaaaagaaacgggtctattatgattcgtgaaactcgcaattcttcatttgtgactttaaaataaggaaattcttatggcgtataccgtatctattgctcctttggctgcttcagcagtcattggaactacaactaattttactgcaacaacttctggcgccacagctgaaggtacagaatcgtttgtatggactgtaaatggcacaccgcaatcttctgttaccgaagctatgaattatattgctgaaggacccgcaggtagtaagactgttaaagtagttgctactgttactccggctgaaggtgaacctgaaacggctgaagcagaaactactctgacagttcagaacaaaactatgcctgcgattactttaactttgagcccaacatctgtttctaaagaaattgggcaatctcaagtagttacagctgatgttactggcgcaccagcaggagcaagcattgcttatgtttggaaacgtggtgctgacgttattgagggccaaacagctaaaacaattacagtaactgaatcagcagaagctaattacactttgaactgtgaagccacggtttctgcagcagattacaacccggctactgtggctaaaggggttgcggttatttttactaaaaagaccatgagtggggtttctgttgctttgactcctgagtctattacagtcgaacaggggtctgatgcatcttttaaagccaacgttatcggtgctccagaaggtgcatccggagtttattcatggaccaaagacggttcccctgttgaaggttcaacaagtactctagaagttgatacatctactatcgggtcacaagtaattgaggtttcggttgttgtttctgctccagattataaacccgttacagtcactacaactggtgatgtaactattactaaaagggtagctcctgttcctgatggagaacttccgtatattcatcctctgccattccgaggaacagcctatatctggtgtggttggtgggtcatggatgaaatccaagaaatgactgtcgcaggaaaagattggaaacttgatgacaccgacagcgattattacttgcatcgatatacactagctaaaatgctagatgattatccagaagttgatgtgcaagaatcacggaatggacgtattgttcatcgttcagctttagaagctggtatcatctattaaaaggagccttcgggctccttttgctttttctagagagtggtattataccaacaactttcactgtaggataaagtaatgacaccgattgagattcattttaagcatgaaaacggcatgagctttattgaaatcgctcgagaagctggcattaagccagaagaagctgcactgcattacgcaaaggttgaagccgctcggtcacgagttaaacgaagagaaatcatcgtctatcgtaaacgcttatctaatactgatgtagaatctcgtcatcaacaactcgtaaaacatatgaggggatttaatgaatcagtatcctgaaaaacaccttggatattctaaggtagttatcaaaaacattcagcatgcattagataacacatttgtagctgcagctcatggttataacaaattcctgagtccgtctgcattttctcgagcattggctgaccatgtacaacaagaatcgaagttctataaatctggaacgaagattatggttgaagttgaaaaatcttttaacccatctggaatggtattagactggatgcggatgaaggttgatgaagactacactatcgcaagcggtacgaagtgcaaattagtttgtaagcgtgatgctcgtggcaataagaagtataaagtaatccctctataatatgcttaaagaatccgcgtggtataatggtttcacggattctttctagtacatacgcttgaccatagaaggatagaaccctccctaattattgatatttatacggtgattataatgagtctagctcaagaatacagagcattggcacagggtgtgcgtgatgaactaccagaagatattaaagctcatattaaagataacctgcggaacgcagcacaacgtggtaagtttgaaacgttttatattgttccagaaaaatggagcaataatgtagaagctatgaaagtattcttttctaaaaatggcttctcatatgagttcaatgctgactatcaaggtcagtctttcaaaattaaattctaaggtgaaatatgtttgagaaatattcaacgctcgagaaccactacaacggtaaattcattgagcgtattcgtaatgctggttttgatgtctctgaaacttgggtagcgcgtgagaaaattcacggcactaacttctctgttatcgtaactaaagatagcattcagcctgctaagcgtactggtcctattctgccagcagaagacttctttggctatatggttatcatgggtcgctataacgaatcatttaaagctgttcaagctgcactgactggtgctactgtagcttatcaaatctttggtgaatttgctggtggcggaattcagaaaggtgttgattacggtgaaaaagacttctatgtctttgatattaaagtgactacagaatccggtgaatcgtcttatgttgacgatttcatgatggaacgcatgtgtaatgtgtttgggtttaaaatggctccgctgctgggtcgtggtaaattcgatgaccttgctaaaattccaaacgatttatccgtagttgtaaattattataatgatattgtaagagatgcaggtttggaaattgctaataccgcaacatacgatgctgtagtatcaaatgaaaatgttgccgaaggctacgttctgaaaccatgctaccctaaattcttccctaacggttctcgtgtagctattaaatgcaagaactccaagttctctgagaaagctaaatccgataagcctattaaagctaaggttgaactgactgatgttgataaggtagctttctccaccctggcagcttatgctactctgaaccgagtcaataacgttatcagtaagattggtcaagttggtccaaaagactttggcaaagttatgggtcttactgtccaggacattctggaagaagctggtcgtgaagaaatcttcattactgacgctgataatcctgatgtagtcaagaaagagcttgtcaattacgtgcaaggcgtaattcgtccggtttggattgaactggtaagtaactaatgcgtttggcgttaatcggttctcgagagacgccacgtcgtgttttagatgtcatgtcattaactggtcaggctctttcggagtcaggccatttttcgtattcgggaggagctcctggtgcagatgaatcatggctcagtagatacgaccgtgagcgttcattacgtatcataccatacgaaggcttcaatggtcttaaaaccggagttggagtaaaggtgtggaaagattttccaaatgaagtgagaatcaggagtgtaattaaagcaagagaagtgacaagttactgggatgagtgccgggatatagtgaagactttatttgcccgcaatgcactccaggtgctcggagaggactgccagtcacccgtggatatggtactattctatgctccaataaaactctctagcgttactggagggacacgagtggccgttgatatagctaagcgtcatgggataccttgctacaatctgtatgagaaggaaatctatcagagattcaaagacaagtacgcgccaacatttgatatatttgctttataactacaaaagggaacctcacggttccctttcttttagtcttcaatgatgatttttggtaacttaacaccaagaagaactgataaatcagaacgtcctgccatcttatccatatccccgccatcaatgattcgagcttccttttcatctttagctacagtatacgggttagcagacagtgcataacgaacgagtaaagctacagaaggctgtaagctttctggatcaacaattactttaaatgcaccaacatgttccgggtcatcaaggtcgataccttcagtgtatggagcatagaaaatactcgatacaacttctttatcaccaatatcttctactacaccaacaattacataatcaagtggagtgttagtatcgcaatacagaggcaaaccgtttgccaggaaaccataagcattctctgatagatattcatcatctccagcttgatgtttcaaccaacctgatgcagcaagaacagcggcagcacgagtagatgctacagcgaatgttgctgtaaaggatgttgagcgctgaatatgagaaaccatttcgcataccatgcgatacagagaacgaccagcttctggggcagatgcataagataaatcgatgaatccagtatctgtgataccttcaactttatatcgttttgaaactgtcacaagactttgtaaaatgtctttgttaatttcatcggccatttcagtagccagtaaatcatcgataaaattagaagcatcaaagccgttagcttcaaggtcctgggccaattcaacagtcaaacttgttttaagtttacgagatttaacctgagtctgccatttatcaatttggaatttagcttcagcgatatcagctccagcagtttcaaacttggaagtgatagcagcgtcagacattaaacgagtagtgagtttaaccagagaaatctgaattacaacttctaaatcagtttcagtaatctggtcaaatggattatctacaagtaccttgtaaacaatgtcattgtatttgaacaaatcgcccttgccaaatgaatctttatttgaagcagttaatgtttcaatagatttacggtcctcagtaccagtttgacctgcgtaggtagcaccagtaaggaacgttaattctttgttagggttcaagtatttgataccatagaaagcagcagtaggttgagtagtacgctgagtagctacaatatcagagtaaattaatttagtagtagcgcgagtcaatgcaacgaggctaggacgggcagaaattgaactcgtcgttgtagttgattcgcgcagaaggtcatggatgttagccatcgtcgcttttcctctagtggattatacttttatttatcatccgtagaaacaacaatgggagccttgcggctcccatttaattggattacagacctttaacccagatgcgacggaagtacgcgttcttaccaacggagttgacgatagaaggcataccagactgaatgcgagcattcggctgctgtgatgcactatcagcaaacgggttgataccaataccgtaacgggttttgaaccccatgaccggctggaagtttttcgggtcggaaccacgcagtggagtcagagcaacgtatggagcgtagtagataccagcatccatctcgttagcacctttgtaaccaatggtgaagtagtcctgacgagcgtactggtcgatgtatactttataacgaccgcccagaatacctgcgaacacagtcttagtggtatcagcgttgaagccttgacccagaccctgagcagcaggagtaacgccagtgtcaacagctgccagagcgttaactacgttacgagaagcgatgatgaagttaccagcaccacgaccagtctgacgtgcgatttcagcagcttctttatcgatttggaacagaagagctttgaagctttcacctgcccaacgagcgccacgaatatctactgggtcctggaagtcaaatacaccagctttagaaccaacggtctgagtcataccggttttacccagttgtgcagagtagttaatccagtctacaacttcacggttgatttccagcatgatttctgtagccagaataccagacagttcagcatctgcatccataccgtgaacagcacgtaagtcttgagccagttcaatagagtactgagctttcagctgacgggatttagcttcgataacttgcttatcgatacggaagcccatttcattccatgggttgtcagtagaaccgttgaagttctcctgcagttccgcaacagaggtagccataccttcagcgatttctaccagctgaccagcttcttcagcagctttaactgctttatccagtttttcagcatcggtagcaccagcgtctacggtgaaaccttcagcaacctggaagtaagcgcgaccaacatcagcgaaatcgtgaactacgatagtaccaacagtcagaacgtcagcagcttttacaggagcgaatttctcagcagcaccctgaccagagaacattgcatctggagcgtacattgggtggaatgcttctttagcgccagcagccagagggtctttaccgtaaacggcacgcagagcgaatacctgaccggttggagaactcattggctgaacaccgcagatgtcgaaagcaatcaggttaggaattgcacgacgtaccatgcccataacagctggtccaatctgagttactgcgcctgatgtctggccagcagcgatgttttgagcatcataaccgtggtcaccaccaatttctgcttcagtcaggaacgaaccaaatgcttcagcgattttttcatcacggaatgcaggttcagttttaatagctgattcctggttttccatgatttttgcaatcagagcttttttaccagcaccaacgatttcaggcagtgcttcgttctcaagcagcggagtccatttttctactaacggattaatctttttcatgtgttttataaccttttaaaaattaagaaagacgtgccgcagaggctacgtatgcgtccatcatcgatggctgttttgatactttttcttctggctcaatgtgttcttcagtaatgaagttgagaccgtcagcatcattgtcggtagtatttatgctttcatttactacctctttctcgacggagcctttaaccatttcgacgatggcagacagcttacttgagaattcgtcggaatattccataccttcggtcagagaagctactttctctttctgaacgtcggtcaagtctttagttgattccattacagcgctttcacgcagcatggtattaattttttcgtcgcgagcagaaataccttcgaacagattgctgatttcttcacgagcttcagccagttcttcttccatttcagcaactacatcaactgattcttctggcagaacaacgttgtgttcaacgaacagctctttcataccagcgaacatggattcaaacagttcagctttgatgcctttatcaacagccagtttgttttcgttcatccattcttgagcgatgtgattgaagaaacgagaagcatgttctgtcagtttcttttcagctttttcttcggcttcttctttagcgtctttcagcttttcgtcagccatttcagcaattttggtaatgtgggattcagccaattcaacggcatgtttcttcacagttgcttcgaatacagtttcgaacttcgcttttacttccggagaaagctcgaccgattcgaaaatactgtccacagctacggtagcttcaatattctgagcttcctggagcaggatgtctttcagcattttgttagtcctgttgttaagttacattattatttataatgctttttcgagactctctacgagagctttaaatgactcatcgtcattctttttggcgacttgcgcctcagcggattccgaaatctgcttcggagttacccaagcatctggtgcagaaggcccccacacagcatcaacgccaacggtgagtttaaatccttcgtttacgatacggtagcctttattggtttccgttaatgagcctagtccacgactagatactccaggaatccagccagcacgaatgtttgcagcgagtttatctccaggaccgtggtcaccttcaataatacgagctcgtccataaacatcgtttcctttccaccacatatcttcgatgatgattgcggcttgcatcgggtcaacgttagcacgtggtgggtgatttaattctccaagtgcttgtttagtagaaacctgctctttaatataattagctacggctttttccaatactctctttggataaagacgcttatttcggttaactacttcggcttgcatgaacacgccttcgatgtataatccaggttttaaccctgcatctgagccatcgtatgactcaagcatcggtacgccattcaaaatttcgccgggttgaccccaatgctcaatgagtaattggggttcattcattagcttaatcctaacgcctgacgacgtttcatagctttcttacgtttgcggttgcctcgtacagtaccagacggattagcgcgtttggacttaacgacttttcgagcgatagcgcgacgtttagctttagataaaccagttgtttggaatgcttgacgctcgcgggttttacggtctttagtacgcgtaatttctccacgagaagaaacatgcttaacgataaattcattgagctgcatttcttcattcagtgaacccatagcaattgctacttcaggttcaattggcaacatgttttctacaattgtatttatgtctgctttatcgagagcttctgacaactgcttaaaacgagattcggcttcaggaatagctgcttcgatgttttcaagtacgacttcgtactcatcaggaacaatcagcattgcgactccttattcttcgtcttcgtcttcagaatcttttcatctttagattcaggtttttctttaccttcatcttcagaatcatctttttcgtcgtcttctttttcttcgccttcaatcataacagattgggcaatctcaacacgacgttggctaatcaaatcagcggtctgttcaagcataatagcaccaaaggctttcttagctttaacgaggtcgttggatttgagtgcggagatgaaatcttccattagaaatcctcttgttcttggtctgggtcttggaaacgagcctctttagactctagctcaatttgcttagcctcttggtcaatttgttcatcagtcatttgaagaatagtcttcattgcagtctgatgagaaatatacttaccgataaacggttcggccatttgaagcatattgaatctgcgttcagtgacttcagcatctttaagttcagtgaagtaactgtcacgatgaaatactatcttaatgttatttatttcatctttccaatcatcttcgctcattacgcctttcaaaataaggtttgttttaagagggtcgaggaaaatttcttcaaacttatgctgcagttcacgaatgaatttagcaaattgtaactcgtcacgtgtaattccagttccagcgtcaaactgaactccactttgttggtcattcgggatacgagacagtggaacacgtaatgcttggtaaaggttgttcttgaaccaacggacatcgtccatttcgttcatgcctgaagcaccaggcatattatcaatttcagtaacagctttaccatcgcggcgctgtaaccaataatcttctgtcattgacatattgtgctgctggtttttaattttaccagtagatgcatcatataccacacggtttttcatggtgttcatgatgtgttgcatatgagcagcagctttacgggaaggcatgttccctgtgtcaatgtaaaatactcgacggtctggcgcacgtgtaatacgataaatcaccattgcgtcttcaagcagtttaagctggttagcaggtttaacagctcggtgcaaataaccgatgatgtttcttcctgaacaatcaactaatccagagtgtgcataaacaactgcagcctttggaattttaattttcgttccagcgtcgtaaattcgaccgtcacattgataagactcgtgcccggtgttataaacgaaatattctttgtagcctttaacaattttcacgcccgcttcagtgtcagtgataacttcacgaacgaactgaatattgcgagggtctaaacgacgaagctcttgaataccttctttcggttttttagggttaataattttatggaagaagatacgagaatcgacataccagcgacggaaatggtcaagaccctttctttcaaaattcagacaagtaagaacttcgttaaattcttcttgtaaacggtctttaatcgcctggctaaaatcagtgttatctaaatccaatgaaaccactggatgatcatcttcgtatacaattgcatctaagacgatttcttggacagcgttatctacttcgtagttattcattaactgacggtaagtatcgataagctccctggtgtttttcattcccggttcattttgaccgtacattctctggaataatccagcgcctgcaatgtctccacgttccgattcaatctctgtcgcgccgtcatcaaatttaggggccgtgatagactctaaattattatttagctgctggtcgtattcctgttcgtcgactttggcccacggcgcgaacaaacttaagacgtcaaatttcattagagtctccaataagggttaaagcatactaatatttatatgggcccgaaggcccacattttacaaccaccagtcgagacagaatgttacttcaaaggtctcaacttcgttgttgctgtcccaatcgagctggacttcaccaacgttagttggccaaacgcccgtaatttcaatttcacgagtaattgttttactatcacgtgcgaattgacggacaattgcttttttcttatactctgcaggcgagccaccagtaatttcattaccctgacctgctgcaataccctgccattcaacaatagcttgacgagtattatgagcatcatcgttatagatagtcacggtccaatcgtcgaatgtacggtcaccggcaacgttaagtttacggttcatataaccgaccggaattttttcaacgataccagcaggcagtggagctgctttacatttgaagctgaagttcttaccgagataaggaatttctacctcaaacaagttaggacgcgcgaaatcaccggattcaaatgcacgagttaaatctgtaagttccatgtgagttcctgttatatttataccgctctgattcaccagagcggccgagatgaattagttttcctaagatgattgtatttatggacctcctctcgaaggcccctaagtgtcttagaattattgagcttgtggtccaatcagttcatcaaaatcagcacccgtagcagtagcaacgaagttcagagtgatgtagttgatagaacgagctggcttgatgtagaacgacgcaacaaattcattgcggtcgattacagcaggcgtgttgttcgtagtatcacataccacacggaattcatatacaccacccagagatttaattccagacaagtactgagaggtttccatacggaagcttgaacgagtgaagttgtcgttcatctcgaacagacgatatttagaagcgtttccaatattcgttttcagcatgttgaacagacgacgtacgttgatgcggtcaaacggagtaggaactttggttgcagtcttatcgccaaacagaacgaatccgtcaccaccggtaccggtcacagggttaattgcttcctgatacagacgatcgcgttgactctgacgaggttcgattgccaatttaatgacgttcagaatctgtccacgattataaccagctggagacatccaaggctgactgatattatcagtacgagcacacagaccagccatatcagcagctaacggaacccaacggttaacatcgttatatttgtcgtactgatatttgtagttaccgtcgatagatgcgtaagtagaactgatgttcatattagcatcagcatatgtaccttgacctgtacgccaatcgaccagattatcaatcgcacgagtcagaggaatgtttaccaatacgctacgtggcggagagataagagccagacaatcttgacgttcatcagcaattgatactacgtgtttctgaacagtagaagcaaattcgtcatcttcaccagcacatgcaccagcaattaaaaggttaacatgaagagcttcacggtcagcgaataaatcccatgcttgcattacatcgccagcagtaacagattcgttagctgatacaccgcctgacagctgaacaataccagagaatccagttggccagccttcagcagtagcgaagatataattgcttgaacctttagagaagaaatcatcaatgaagatgttatttccgtaaacgtccttagaaccgcgtttagttgaaagaacaaagctttctacaattgctccgtcacgacgaacgataatgcaatattggtcatctgactgaggaccgtatccaaacactgcacgggcagtagaaacacgagttccgccagcaggataaatttgtaattgggtgtttgcaccttgttcaaatccagctttagaaacaatttcaatttctaattgagaaccaagttcacctggataaagagcagcgatacctggcatgccataagttttcaaagcagcttggaattcgaccgaagtcatttgctcagtcgcagtttctggctcagttaaaagaacaccagaatcagttacaactttaccaacggccagagtagcagcaacaccagaagatgcggaagtaacttcagcagtccagttcggtcctaaatctgggtattgattaattgattttgcgtatgcaataatttttgcgcttggtactgaaactgaaacaataccaccgttaccatcaacagcagtaactttaccagctgattcaataacgtttacgttgtatttaactcgaacggtatcgcctacagcatagtttgaacctgcagcagaaatggtgatttcaacgttcccagcaattggagatgagtttttagctacttcgcgatttactgcacgagaaatacgaagatcattaccatattgcaggaagttcattgctgacataaagtaatcagcagtttcgctatctggagtgccgaaaatatcgactaattcgacttcgttagtcacttgaacaacttgaccaaccggaccccactggaatttaccagccagggccgcacgcccagtagcattattaacaatagtgctttgtacactagtttctttgagctcaacgcccggagataataaagccattaagaattcctctacatgtgtgctttagtatatttatataaacgacacaccgtgagttggcgtgtaatctgtaacgtcacgtccgtcgtctactaaaaccactggagcgtaatcgtcattcatatcttctaattcgttccggaatacttccgaagcgagtcgaaggtcgtctttgtcagcataatctgcaaacttagtttgcgttgtaagccatgcgaagattacgagacccatgattaagtcgtcatgataaccttcttcagccgcccaggatactcctttttcagagaatgtcctgaattcttgaacagtagctttgtgatggatgataagcttatctttttcaataaggtctttaagcgtagaacaaccaactgctttagtacgcttagtctgtttcatcccaaggtcaaccattgaatcacaaattacgttttcatattccaaatccatgtaaagagatttagcaactgatacgccggtactattcagttcaatataaactggagcttcgttgtactccattagatatttatgcacgatatctggaaggataagatgcgatatgctattggagtgaagaacaccaacctgttcccattgaggttcagtgatgtcaattatatgtaatgcatgatagtcttgtccacggccttctgaacagtccaacgcagcgatatattttctttccggctgggcttctttaaacttatagaatccatgattgtctggagttacttcagtccaatccatattagcaagtttcataccagaaatcagagtacctgaagtaccatggaattctgcgcagtgttcttgcttaaattgttctaatgaagaagctgaaatagtctgagacgaccattgccaaccgtcatcaaacatatcttggtcgttataaagacgttctttaaccgagttccaaattgcggtgtacggctcaaaaccagacttaccagataatgcagcatcccaaatatcgtagaagtggtttaatccatttggtgttgttgtgataataatttttgaacgacgaccagaagaaattactggctggattgctaaccatgcatcgataaagtttggaataaacgcacattcgtcaatgtaaatcatcgcgaaggagttaccacgaacggcgtcaggagatgatgcatatgctccaattgaagagccattatcaagctcaattgagcctttgttccattcaacaataccaggctgtaagaagtctggaagtaattcaatagcctgcttcgtacggtctaatacttctgctgacatcgaccctttgtgagccaaaataccaacagccttatctttattaaaacaaacgaagtgcgctaaaaatattgctactactgtggttttaccaagctgacgagacaggttacaacaagtcatacgtttggaagacatgattctcaacatatctcgttgataatcacgcaattgaaccttgattgtaccatagtcaatgtgggtaatggcacaatatttctcagcaaaatagactatgtcatcacgacatttcttccattcctgaaccatttctctggtccaattggttttaatattcgctcttttaaggttcggaagccccatatatctggagcgtttattgttcttgtctttaaatgtaccgaaattagttgggtcttcgccttgaagacgaatctttacaatttggtgaatgcgaagataatcttcaaacttttcgggataccacttttcatcccattgagatttgaaaaatgttatcccatcctcaatctttttctctaaagaccccggtggacgaatgacaattttttgtccttcattcaacgggtgataatcatttagtacgttaagaggttgttccatttattaccttctcttctctggcttcttgcgcttcatacgcatcgccatattcatccatcatatctgacggagagcctacaaacactgtagcattattaatgttcaccgcttgattaccagcacctttggtgttagtattctcattagtgatttctttcatttccttatgaagtcttaacagttctttgttagtagaagtcatctgaccaattaacgtagaaaatacttccatgtggcgaggagaatcggagttcttagctgtttcaaggaatattttagctgcatccattagcatttgtgattgatgatgcatatttctacggactattgtgtagtcatcttcgaggtcaggagttctgttttgtggatggctttcaacaggaattaattgaagaggctcatatgccagaacctcttctccagtaattccaggtaaatccccaatatccagcaatttagtaatgtctaattgttcgctcattatacacctcgtggtccaggcggttcaggctcttttggaattggagttgaatcgctatcatatttctgaatagattttccgtcccaatcttcaatttcaacatcgcgcgggtctacttcagaatccacagattcaaatacaccttcatttaccaattcacgactgttagcatggaaatcaagataaattgtacggatttcaccacttaaatcgaaagctggaggataaagccaaccattcacttcaaacatgatggaccattctaatcttcttctagattgtttgtctccatcgatttgttcgtcaattgaaatagattggaaagttattcttatatctctttcaaatgtaatttcgttttcgaatagttcagtcattgtggtgttaaaatgaggttggaagtagggcataatttgctctacaatttgaaacatatcgtcctggtgacgagtaaaaattccaagctcaaaaatcattttaatcggagttgggttgtattgagaaatagtcccagtcttcgaattaggattgctcattgctgaacgattaagttgtccagtcttataagttgggttgtacatcatatcaactaaatgaaggttgatacgtggaagaattgtctctactttcgcaggaccgtcttcattgttaacagaagtccatttattcagcttcatcataaagtgctctttagaagcgtaagtaattggaactctgatatatgtcttgcctatgtcttcgcgcactctctgaacttgaatattggagaacaagtcacccagcattaggatgtatctgcgcaaagacgagttataaaaatatccgaacattgtttctcctaacggctccgaagagccgtatatgcttttaactatttatagcataaaaccatcatcaaatggagatgctacatggttagcaggtggtctgtttcttggcggttctaccttaggtgaaccggtaccattaacgacttcatattgcttaacgtctttatcagcttcatcattcatttggtctacttcttgatacggaacttcattgatatcagaaagaccatctaattcatgaatagggtctaaatcaagctcactgaattcaggaatgttaattccatcattacgctgaagctcaggtttaagctgctcgccagagtaaatgaatttttctgctgtaatcttacgaatagcatttcgtccagcttgatagaatgggtcatacggctctacccaagaaatttcaaacaagctgttgtccatcggaaagtaaattaagtctccttccttaggttcttgcccatttacttgatgcttaaagagacctgggttaattgacaaagtaacttcatcattaacctgcattccgaacttgctataaaatgtatttgctccttcataaccctcaaatgagttaatgtaagctgcaaattgccaagctttagtgaacttggactgaaggtcttcaccaaagacgtagtcaggttttacatattcacgcggaacgtagtagcatttaaccccacgcatttgaatactttcagccacaagagtatcaaacagagcttgggtgttaaaatgattatggaagttcacatatggatttagaacttcctcttcattagtgcgtgaataacctgatttgttctcgagcttcgcgaacaaatttttattcatcatcctacaagtactcctgttggagggtcaagtaagtaaagctgttctaaagcatattctttttctaatcgagcttcttcaattaaacgttcaccatttaatgtgacaccgcctggaagctgcatgccttggtgacgagctaatacttgaccaagtaattctttagccagaatatgagcgtaatcttttacccaacggttgttatatgagccttgaacgattgaaagttcttcaccagctctgtagccagtcaaacgtttatctgggttatcatacatgtccggaagagtccaagatgattctggaccagctgttccataccctgctgtatttccaaccattttgtccacatcaatataagatttagtccagcattcaactacaataacatcacctagctggaagttgcccataattttaagctgaccagtggcatcgttgaaccaaaaatctggaagaggagcgagcatatcttgcatcatcgaccaataagttgtgagctgagtgaaatagccaagatcagctccaaatgcatttggtccataagctttattacaagagctacccataccgccattaattccagccattcctaataggaaatcagtgaaccatggataagtagcattgccgtccatactcgttaatgaaccaacgttagtacgaacaatttgtgtgactgcgaaaatgttgcgatctgaaaaatcaaacacaccatttttgaattgaccacgaccaatttcgtcatcgccaatatgaattacttgatagcctttatttaagccgtcataatgatattcaccgaatagctctaaagctcgttggatacaatcataaatcatatcttcggttaattcgacgttaatgattggtgcaccaaggcggcgcagaataacgtctttaagttcttttggatttcgtgcggtatttgcggccatataaacctctaagggcccgaaggccctatattatgctgccgggtcttattccgaagcaggtggattaatgatagtgtctaagtcgacccaagcaccgtctttacgaacataagcttttccatcacgaggagcttctggaattaagttctgaatttcggttttaatgtttgaaatatcagtgtcttgggcttttgctacgtttaaaagtcctctttcttcaacagtagctctgttagggtttgtacccattacaagactatttaaacgaattacttgaccttttaaaccttcgttattgttaccaatatctacctggatatcctgaatggtattagccatttggttttgcatggtagtcagagtattaatctgtccaattaaagaattagacggagcaggggttccgctttcattaataccaactacttggttaatccatgcaacttgtccacgtaaaccagacgaagtatctgcaccaacaatagatttcagagctgtaatttcatcacggttaattttaattcttccgttgatgcttgatggctgagaatcttttccgatagctgattcaattaaatctacgcgaggaattaatcctactgtcgggtcacttaatttacgattgacttcagcgattgcatcgcggttaattacaaccaagccgtataaattgataactccattgttatacccaatcgaatctaaaacgttttccatgtccattgctaaagtactaatagttccattcattttattcaaacgaacgtaaacattatcaataccagcggatgctcttggacccatttcatttcgaaggttttggacttcaatagttaatgaaccaacatctgaatcattaaattgtttttcaatattagtgatacgaatcgagttatcatttacagctttagcagtgtcaataacacgcttcttcaaaccaagcgctggagccataggaatagacataccgttgatgtcttggcctggataagcgcctaactcagttttaatccaaagtaagtcttcacgaactggacggtaaacagaatcgcgtgacgggtcatattcacctacatcttcttcgatgtgagttatgcgcagaccatggtcatctgatgtggttttaagtccctctgtgtcactctggagaactttaattgcagatgtgtttaaacctatttgtttgacaacatcgacatccccaatgacccctagggcatcctcgacattcttaattcttacgtttgattgctcaagagagttacgtacaactacgatattcccatcgagcacttccacgttttgttggacctgcaccggtccacggttgagattaccgtctacaccatttttggtggatgctcctgttaattcctcgccatttttaatccagtttacacgagattggccttcatccggaaggccgttgacgtaaggaaggggagttaaatcaatagttgacatatttttccttatcttacttttataacaaagtttagagcaattgaccaaggacggttttcatcacccattaatccatcagtattcatagtaccgaatgaatcacgaatattagctgcttcaacttcagcaccatcattagtaaaatacttatagttatcataatctgaacgattagagcctaagtaaccattacgtacagtacatccatttcttgcatctgaacgattatagtgttcaccccatcctgattcatgtttgtgtttacgaacagattgcggcattgattgacctaatgaagcattaccacaaccagctcctaaaccaggtttaccttttgaatcgtttcctgaatattggttcatgatgtttgatttaccaacaccgcgagggaacatgccgcgcatatcaggaagagcaaaccgagtagcgtctccaccatatatagtgccaataatactgtataaagtagaatattgagaatcccctttattcaataacgctccgttacaatgcatccaatctgagcttggagggttatttcctggccacatgataattgttccaattggaacggaatcaactaacatgttgactgtagcaatttgctggttgttaataaacccagaaccgacatcaagacgaccatttactcgtgcagcgccaaacgttgtggttccattaattgtttgtccgccacgagtatgaacaacatcagcgttatatgctaatgcagtatttgcgtcacctgaacctacggtagttgttaatttaacaagaccttttgttgaagtagtaccaactctttggttcaatccatttggagtaacaaaaatatctccggcagtatttgcgttaacttcggcgatagtagcggaacgagctaaacctctgcgagaagatgtagctgttaaagaggctaatccacttggagatacggcatacccgtctcttagagttccttgagcaacttgcccgttagtagcaatacgcacagtaccacttactgattctgtcgctggtccataaactggaagaactgctgttgcttttgcaattgctctttgggttttcaatggagtcattgccgaggtatcatcagtaccggcttcagccattgcaactgtagcaattttaattacacctaaaactgactctttagaaatacgagtagcaaacgcattatcaattgaagcttttaaccctgttggaacaacagcagcattgccaatagaccctgcagtggcttcagctgtagtagcatatcgagttaaaccaattactgtagtagaagcttgcggattaccaagacgttcttttaaagtttttggagtaactacagtattagctgaatcaccatcattaacttcttgttgggtagcaatgcgaattatccctttaacagtttcagttgcgtcagggacgccattaactgctattggctttaatgcggctaatgccgattgaacgtttgttatgttggctggaaaactagttccagccgggttaaacgttttatattttgattcgtcacttatatggtttagagtattagtagccattaacccattctcttaaagtattgtaaaactgtcggtgaagtagctccatcgaaagttaatgattgacgaccgattaaatcccatgacccataaccaaccttagaaggagactggattgaagcagagatggaaactccacatgaagaatatgagggaagaatatgttcttggttgtcgatatatttaacatttaaaatattaccggcagatgtagatacttcaactgaagaaattacatctccagcagtaatagcgtcctcaagaaccaatttaactttcgcggcaaattcagtgtcagtgtcaccaattaaagccggaaccataaatccgtatacatcaactaaaactgattcaccttcagattttccatcaactgctactgttccggtaaaagtccaatcatcaatttgttgaataccttcaggagaaacgccagtatcgttaattacaattgttccaattggaagaatagcgaatccacgaacatcttctatcgctgattgaacatttggaaaatcaacacctttatatttttgtgaaatcgtatttgacccaattggctgagtattcataacatcaatactgcctggggcgatttcatattgcaagaaatctgcattgcgggacttaagtcccgcctttgaagaagatacactaatcattaagaaacccttaaccaacgatatgcggtaacatatggctgaatattagttactgattttggaggtgtgtgagtcgggttgatgttagcaaccgattcacgatatttagtataagccggcccttgttcattcgggtcaaattgacatccgccgacgacaataggtccgttagggtcaactactaaaactttttcggttgtttgagaagcaggaatttgagcattttctaattcattgctaattacaccaccagttccaccagcagtatgacttggattaccatttacatccaaatcgttattgttcattgcgaaattagggtcggttgtatcgttattccagccagcaacaactttaccttgtccccacagaacccaagtaccaaatcccatatatgttgctgggttattagggtttactgcgttttcgtaaattgttccaatcggataaaccaaatcaaataagttttgaacattatttacttcaacagcagcagctggttcaggagcaacattaggccaacctggtttgttttggttagtaatacgtacttgaccagtgagattgagaacttcgcctttagatacatattttgcgtcagtttcattaagaatgtcttcaagctccattactgtaccaatttggttgttgtaccaagttaaagtaataatgtctccatcttccatttcacggtctgtttcgataccaatcaatttattattgtcatcgatatcaagaacatagtcaagtttactgttttgccaagttccaccaagtgcctgacatgtaaatgcgtcatctgcaatagcatcaatacaacgagctaatggaagacctgcagtaccagcttcattctgaagtattccgttaaaacgaacttccatggattgatggtttacaggagaaaaactatcaataccaaatgcactcaatggaaaatatctgagagtttttaaatcgtcaactaacaatgaaccttcaatagatgtctggttagttttagatgaatctctcagagtaactgatcgtctattgtaagaactacggaactgagaaataccgtctaagtaagatactacaattacagtatcacccgcattagccgggtttttcaacttaatgcttttgccatcaagcgcaactcttgttccatttggtccaattgagccaaaatcagaatcagttgcactgaatttctcaccgtaatacagaatgttaccacgatggaatacttgggtatttccaatgttgtattctgttccactgaatacatcagggaaatcagtttgtccgttagttttaactaaaaactctttacgaactactgtgctcaattcactatttgaaattctgttgatttgcttattttcaacatattcccaacgacctggagggcaatacaccatttccaagtcagcgaattgagtgcgaatttctcttggacgagaatcaccttttaaagtatctcctgaaccaggaataatagttatagggttaacttgccaagttgcataaacgtctcgtaaacgaatgactttattataatcattcgcagtacctttaggaagacgcacatttaaacgacctgttgaagtatcaagcacataagctttaccccattcagcgtttaacgtggctgctgtagaagtcttgtggtttttccacgcgccagcagcaaacggaacatctccatcgccaagctcgtaatacaactcgtcaaagttatcattaattttttgaccacccttacgcaggtagtcgccggagccgtcatcaacagcttgaccaattttaatatcttgcttcatcttggattcccaattttctgtgtagcgatagctttaactgccgctctcaaaccagcgactcctggcgttaatgtcaggactacatatcctgtggtagggttaatagaaaatgacggaacgaaaattttgtctatcacttcaggagttgtagaagtagctggagtgtcaactgctccaattcgaattactgcatattctacactattaacttctctcttaattctgtctatgtgaatatttatttcgcaacttttggcttttgaaccattgctggtttccgcagtaataagatatttcgctatagtaaattcagtattatggaacaacggaatatctacagaagtaccaacagctcctaattgccaagtgccatcagttggaatatgtttttcaccaaacatactttctactgaataatcccaaacagaacgaccgccttcatcagaaatacaccagcattttacaaatacataaggagacgtaattcttaatgaacctgttacagttgcaaatgtgtcgtttgcatcaatagttaatgggttagttggagagaatgagccattgctgttgcagaaaaatactgcttccccacgaacgcctttacttaaagtaacttgtacagctccacctgaagtgtcaatatcatattgcgagccgttaggaactggagtggtaaattccaacgggtcatttgatttctgccaatagccagtagcatgaattacttgtcctacgccttgaccttggccattatcaagtgccattttgcgttggtctccaaaagcattataaatgccgttgaagttgttgttaattttgttaccgccatcgaacaaaatatcaccggtcgatgcgttaccaatttcaccgacgtcaattagttgttttgcttcttgttcgaacataataagtcctctattgatatatgctatttatacaaaaatgggagcccgagggctcccgcattagaattcgaagatgatgttaatttcttcggtttggtccatagccataatgataggaggcctgttttccatgtaaatcatttcaccggaatgacggcttaaatcaatagggttgtaccataaattcttagcctttttatttggctcagaaggtatctttttagcttctaatggattagtaataactgaaatttgacggaagcctttgttaccaggtaaagctgcttctgggaaatatactgaatcgaaatatgctttaaatcgaatagtatatgcttttacgcgatagataattccatatgcgtcatgttcccattccaagttattgttgtaaccccaacgttctgggtcttctttaacttcatcaggccaaggaacgacaatatattcgtttgtgcaacggttgatagaaacatcaggtggaatctcataaagatattcccaaagatatccgtctttcatatcaatcttattatcgtttattgcatcgccacgtcctcttggaggaaatgctgattgaacggaagaagtccatttaccaccaagcttaatacactcttctttatttttgatagtattaattgaacatgtgcctgcatcaggaatatcaatacaacgatataccaaccagccactacctacttctgtggcgttatatggagcactgtttacaacaacaatttcaccaattgaaaagtttcttgggttaggataacgaatatctccccaatctttacggggaataattgcgtccagcatagaaggcattacttttactgaacccatcatatgagtccacatatcttcaacaccttgtgtattatctactggatatggtggggcgaaccccacctccgattcgttatctgaccaaggttcacttcgtccgaatgtgatgtaaattgtgttttgattatcgccatcaccaattgactcataaaaattcagcatcttttcagtacggaattttgaagtcactatggaacgatagattacgcttgaatcattcattaatcttaacctgtgttggattagccgggtcacgagggatattaactttatcaataagtcttgaattaaccaaatctctccaattggagaatgttactgcactttggtcgaatgtagggctcattggttttcgtctttccgatggaagctgaccagctattactgagttattgttttcagcatcatagtcggcaggaatatcaaagtcttcgtttgctcttggatgaggtaaataaagagcctctccagtaacatcgttatgctcgatatttccatttgaatctaattgagctactcggtcaggccaaataagtggaagtcctgcatcccatttgtagtttttgtatttattgattatagtttgaacgtgtttaagggtcaaaccaacgttaatgaacatagtcaataacgtgataccaataaatccaaaaccgactggatgaacaaatcttaaaacatcatttctgtatcttgacgtaggaagatttgatttaattttcatcacatagtaagaacggttacggttgatatactcgatggtgttttcaaccaattctttaccacgaacgccttggacaattgttcaaggcgttcgtggtaaagaattggttgaaaacacc

SEQ ID NO: 3 - DNA, 174829 bp, Unknown
  bacteriophage genomic DNA
aagttagaaggctgaacctgaccagtagatgatatattgtcagttactggcaatatatcatctactggtcaggttcagccttctaactttagtaacttcgattcacgttatcagaacttgttccctcctaataataatgcgttattagaagttgacacttcattagacggaaataatgctggtggtaatggcgtaactcttattgggcacaactctggaagtaggtattatcattatttccgcggccgcggaagtgcaaattttgatatggataatggtgtatacataactaaaggcggattgtcagttactggcaatatatcatctactggtcaggttcagccttctaactttagtaacttcgattcacgttatcagaatttgttacaactcggcgccaacgtgaacttagatacgttagctgggctggcagaagccggtgaatatgcccagcactctaatgtaaacacatctttggctttgaactatcctgaagcactcgcaggtcatttaacagttacttctggtgcgggtgttcaacaaagatatcatgtttataatagcacccgtgtgtatttacgtgcgaaatatagttctggctcatggcgtccatgggaccgggtagtaacagaagattatttaaaaactggaattcctgcgcagtttgtatctaaaaactctgatggtttccgtattgcatatggtagctacgggttctttatccgtaacgatggtggcaatacttatttcatgttgaccaactctggcgaccaaatgggtacttggaacaatcttcgcccgttaattataaacaactcgacaggccaagttactattgatactccattaattgtatctcattattctggacttacagtaaatagcacggcgggtgatgctatttcatggggtaatgcaggtgcttgtttagcaaacgatggtaacttaaaaggttcacgctggaaatcttttggcggttctgattgggcgggtgatgctttaagctgggttcacggtcaaaacgtttctaagtctggcgatactatgaccggcgcattaagagttactaactggattagtgccgataacgttaggacttataatgatatagaattaagtaaaaacgctcgtcgacatataagatttaaggattctaggggtgtagatgcatatatctataaagatgctggagcgaatccacttagaattaatttaggtctcgatggtggagattggcaattccaagtaggtgggactttttacgctagcggtaatggtgatttcaacgatgttagaattcgttctgatataagattgaaaactaatttagttaaaatagaaagtgctactgataaaatagaaaagctaaatggctacgtctatgataaaaaacaatctttacatgattcagagtacaactctcaagaagccggattgattgcgcaagaattagaaaaagtacttcctgaagcggtttcagaactttctgacggaactaaaactatttctagttctgcaaccatagcgcttttagtagaaagtattaaagagcttaattctagaattaaagaacttgaatctaaataaattaagaggggcgtaaagcccctgaggatttaatatggcagtaataggccctatggttggcagttcagctaaaaacgagactgataaagaatggatgtcgcaagccggaacaatattaagaatgaccataccgtttatgatgtcttctatgattgggcgctctaaagaaataacaattactttagggtccaatcattcatatgatagaaatgacctgattaataaacttcgtgcattaggttctacacctgcagtggttgttatttcaggtgatttagttgctcaaaatactggtgttccttgtttagaatttccatctaacttacctaacgaatatgttcatttacgagttaatgctaacgtatatggtatgggtggtgcaggtaacagcaatgggcaatattcagggcaacccggcgggccatgtattttaaacaactttggcactcgtcttcgtattgaaaataatgctgctatttgtggcggcggtggcggcggtggcggtgtcaaattatcaagtgtagtttctggtggttctggtggtagaccatttggcgctgctggtatagcatcaggtcgagattcacatgatggtatagcagcaaccttaaccgagccaggtccaactcctccacaaactcgttataatactaccggtggtgcaggtggtgatgttggtcgccccggcgcttctggtactaatggcggtggcaatgttactaaccttccaggtggtgccgctggagctgcgctgtatggaaatgccccaacttggattaaagtcggtaatgtttatgggactcgtttataaataaagtaaacaaaggagaaacttatggccatgccaagtatttccattgtagacttagtatttggcgtgcttgaccgactctttaaagatacgacgggtaaagttccttttacccgtattttttccgttatactattatttgttatggccgttatttggtacaaaggccctgagctgatgaccatttataaggaatctcgttacgaaatttattctgctatgcagcaaaagattggtgacgaaaaatttgataagactgttcgcgaacaagtccaaatagttcatgtctccagtggagcagattttacagcagtatatgcatttcgaccagtaaacaaaaacttttttgttgacatggtcgcttatgaaggcgttctaccatctagtgtgaacgaacttaacttaggcgggtatccaattgacaaatcgtcagctgaatatattagacatgtaaatggagaatattttagttcaaatacagaatcaatcttccttccaacaaaaaagaaaactgacttcaacttcatgttttcttgtccctacttcaatctggacaataattatgctgggaacatcagtttgatgtggtataatgatgttcccagatatagtaacgaaaggttgcaagctatttgtgcgccagcagcccgtctgataggtcgttcacgttagaaattggaggcatacatcattaagtatcggtgtatgtcttcatacccttcgttgaattgctcgattaacaattcacgcccatcttcagatagttcacggaaaagtttattgaaagatagattagtgagctcacgccctgtttcagttctaattcctaactcattcaaaaatgcaatgaagttatcctttttcatcattacatcttcacaatccgttttaatcaaaatagaaacaatagtggcaatttcagaaacgatttcaaatttagtcattgtacatcctacatcttaatggtatgctttgttagtatgaaagtatagtatcatgttacaaggtgaatgtaaacccagtgcctttagcatactctttgaacttttcaacaacgccgataatagccttcttatctttagcttccagataaacgccacggttgtcttcagtgacatccatatgtgtggccaggaagtcaggccaggacgcttcgcgtttatcgatgtataatccaatcaggcctgaaataaaacgtccacgcgctacagaatcttcacatccttcacttctgacacataactccagcttatgcactgatataatagcctgggccagatcgataaattcacgatacgcgtttgattcctgttctgctacagagcgtgccatatcattccaggcagagaagtcgaatgctttcattagtagtcctcgagcccatagtcttcaatgagttcgttcagttgtgaaccaatcacagaaaggtctgtatcttctctgaacgctacaattttaaaaacaccttcatacaaataatctactgcggcgtctttaataccgtactgagcgtcttcaagaatcccagcaataacttcattaacgacgttacgatggattttcttttcgaactcttctaccttaacgttccaccaaaggcagaacgggattgttcctttatgagtaatcatgatctttacctttatgcttctgtttacgttgggaatcagaggcagctttcttacgatctttatgagcaccacctttgttgaaatcatgcttcgctactggattattcataatgcttgattacctctcttaaacatccacctgtaagactgaaacgtttggcaacaccacactcaataatatgctctgaaagcatatttacatcagtataaccaagctcaactatgaagtattttattttagccttttcagaactattcaggctattaaaataatcgcttttggtataaatcgctctcattaataaaggtcctctgaataaagttcgtcttcacgaccaccacgttcaatacgtacttgatttgcataagttgcaataatcattgcttctttgcgagtccaatagtttgaatattgatcaataaaaccttggtcgtcgtcataagcgtgttctgaaaccagtttatcggaaacggcgtctaatacggcagccatatctttggaataatgtcttgcacctgggatgaccaatgttccaccgtcttttaatttaaaccggtttgcggcagaaacaattcgacgttggaactttttgtcgtcaagccaatatgctatttcccaacaaatctcaggaacttcacctagaacattctgttctgtatattcgccaccgtattctgcaagtttagaagcgagactctcaggagtctcacgagataatgctttatctaaaagggctaaacgttctttaaaagttttcatttgaaccacatcttaactcgcatccataaggatttctgagtagctttgttaacaccgtacgaacgaattacaggctgagattcttgtaattcacgataatcgtctttagcaatctgtacggcttgaggaataaagctagagatcgcagccatgaagttcgtacgttcgcctagtgggcaagaggtatcacaacgaacaatttcataaagaccagtcttaaccttaacgatagtaccaagataagcaccgtggaaccatacatcccaaccttcttgggttggttcaacacaacgacggagttcgttcaggatttcaatcttgttcatcatactttcctcaaattgcgtttacgattacagagatgatgtcagccgttacagcagggaaatcgatataagtgtttttgccacctactttaaacttaacatcatagcctaaagaagtaaagattttagcatctttatcagacatgttgtaaccgaagatacgaagtgaaccatcacgacggatttcgatttgacgaataccgagagtacgttttacaaactgaatttccaggttgctacggttttcacgagtttctttcaagtcgatacgaccgttaagaccagctacaaccaggtcagccagttctttcatagtgttggttacaccacgagctgaacgagttttacgtttggtcaacatttcaggagcattttcagatgcgaacagatcggctgctgcctgaacgatgtccatagcttcaccagtagcgattaaaccatcacccgatttttcaatcagacctttcttaatcagaacaccgatgttagagttaactgaagaagcgttcatggtttcaaccagagcttcacgaacttcagcagaagtgatgtagttctttttaacaacctgtaccaggattgcagcagttttttcgttcagaacgtcgttagaagctttgatgatgtaagttactttagacattttaaatctccattatattttgttcatttcgtttggtatgagaagataataccatgttttaatgctgttgtaaactgtttcttaaatctttttgaaagatttcttatcaactgtaacgcgatggcctacagatggaacgaagaaggtccataccttagtaccacatggagcaacatcagttttaaccagttcgccaaccacattagaataatgtttgttattgatgatagctttcattttatttctccggttgtttcaacattttgttggtgtagaagcataataccatgttcctacaccattgtaaacaccttatgcaaacatttttctacagaggtcccactggattactgcatagtcaaatttgtaatctaaagccatgaacatttcaataaatgtggctttatctgtaactactggatgcttatacagggcaattgctttgcgagtaggcttagcaacacgtttcttttcaccaccaaagttcggagaagaaggcttcttagaacgaggcagttcacgattagtgaaagcggctacatcaaagtcagattcttgacgagtatggcctgagttaatcatccactctttacggaaaccaggaccaccttgaatgtttgcggtagcacgagcatgtgtatcaccaagctcgacagctttagcacgccatactttgttatggccttcacctggggttaaagcatgagctaattcatgaagaattgtttcttcaacctgagcagcagtcattgcgaagaagaaatgcgcctggatagcaattttctttctccaagcagagcaatagccaatgttgcgttttgaagttgatgaaaccacatggaacgtccaaccttcaagtccatgttctttacatttagcttcgaagaaacctttggccgattcaactgaatgatacaggcgaccttcagaataaaaagctttagataagatacgttcgataaggttcatattaagttctccatgatggtgtaagagtatagtaacctgttctaaagcagatgtaaacccctaaaacgcaaaaagagacccgaaggtctcttaaaagaagtattcaatgactaagtatataatccataagaagaaaatcattcctacaaatagaccataaaaagtcatcttgctaagctcgccagatatacgattagacgagtcacagcataagaaatcaatgcagatccacatgccatagcaactggctgaccggccagcaaagtaaggccaccaaacaaggcggcgctggtaaatcctacgaatacgctcattttaattcctctaagtctttaagatattcagtcgtgacatcagtcgacttccagtattcgtgttcttcttttttagccttagcttcaagagcaagctttttagcttcatcggaagtcatatggaagatgttcatagccactaatttttcggcatgatcgccatacacttcagaagcagaaagttcttcgactaaagctttacgagttttgccttgaacaacaacgacaccatcaattacatctttaatgaatcttgcctttgccagagcaaatttaaaggcctcttcagtttctttcagtttaccatcaatacgcttctgaacgtaaaccttacgaacttctacaaagtcacgaataagctctgaagctgtttcataaacttttagcttacctttttcattcacaacagtaatgttctgggaacgacgttcaatcaggccaaagtctttcatgattttatcatgacgttcttcttcggtttcgccaagattatattctttacggaatttaactttgaacccaaatccattttcatcacaggcatcatcccatgtaatgaaacctttttcttcaagagcatcaagaatttttacatatttttcacggtcatatttgtacggaacttcttcaataaccatttgtgttcttgaagtgaatttgtacttaccatgaagttcccaacgcccatcaacttcaactacatcgcctttgaattcagggaaacttactttcggctcagtaattttcttgccttccacagcttgacgcactgctttcttgaccgaggccatatcatgaggcagaatatcagtagcataaccggtagcaatgcccgaaacaccattgagaagaaccacagggataataggcagataaaaagcaggaggaatgtgttctttatctttatgtaccggagcatactcagtgtccttatagacattaaagaagtttttgcctacacgagcaaaaatataacgagaagctgcagcttcttggaccaaacgagaaccgaagttgccttgcccatctaagattggatagttgttgttccatgtgttcgccattaacgcacctgcgtcctgggcagaaccttcaccatggtgatatcctaagtctgctacaccacctgcaatacttgcaagtttatggaatttatcacgattgccacgacctaattctaaagcacgagcaactacaaatcgttgaacaggttttaacccatcaatcatatttgggattgcacggttttctactgtatacattgcataagctaaggcttcattatcaataatacttttcagcccacgaactgtaaaagtatcactagcctgtttagccatcatgtcaaaaatatctgtcataatacctaccaaattaatgaagagagttgtactataacatcagaaatgaaaagcacaatagatacgagcccgtatagaactccataataaagaactaatgctaaaacagcggccactaggaccgccataagaatctttttcatagtttaaagattacaaagtaaagaattaaaatagacatcagagcggatgaaatccctgtagccggcaaggtacctgtaatgaataatagagtcatcgcagtccagacacaacataagaatgctttcattagccgtatttcgcctcgcgacaaattccaccgatacaagaaaggatccaaccgatgaacataaagcctaagaatgtagtgcttggaatccaagccccagtaaagaaacaaacggcacaaacaattgcgacgattaattcaataaaaacaactagaatcatttaagaaccccacacaaaatggccaaacgttctaaagccaggatagccacgccatacgcaaccagcccaacaataccaggcgtaagaggagcacctaagaataaaaaggtgcccactacaaacatcatgcctatcagataaagataggccatgcatcttaaggcgtccattagtagctctgcagaatgaatttaaagttatcattcagcatacggttcatttcgctgaagttctgatattcatctttatgcttagaagtgaacatcagagacagttggcctttaccaaaaccagtggtcagaggtttcattttctgagctggaacaaagtacacatcatacacattaccattagaagacagtgtacgaccgagttggctacgaccctggcgaatctgagacagaacgttagcgaaaccagacttagaacgctgacggcctacgaagaagcgagcagcaacctggcgccatggcaatgaacctttaaccatgaaatagaaaccaggttcagccagagtttcgttatcgacataaccaacagttttgccattttggacggcacaaacaactgtagcacctacagcttcgaggtcagcacgggtcatatagttacgaacgtcttgatgtgtcatattaatttcctcagtaagtttaaattatttctccaaggaggacattatactctgtcctcacgagtttgtaaactatttctttttcatcagacattctgcatgagcatagttcaggtcatcaagcgtaatgatatcctgcaacagacgattaatctgtttgccacactcataacaggtaaaaattcgtttaatagtcatttagccaccaatgattccaatatgaattgagttgatgccaagccagtatgccatgttaaaacctacataaaatgctactgcccacagaaagccgccgaacagatatttcaagaaatccataatattttcctcagaagaagtaggcaaagtgaacacgaatcacatcaatcatcagaacaaccgggaagattgctaaaaccattgcaatcacaaacatgttccagatagctttcagtaattttttcatattcacctccatttattcagtacagacattatatcatgccgcgtaatggatgtaaacactcattagtatacaaaccaatggaatactaagaatccatataaagcaccagaacttactcaaagcctgcactcccgataactaaagaagttttgttgtcgaagattttgcaagaaccattacgatacaatgcagctaactctttggctgcgttttgtgcttgccacgggaacataaattcttcccagtctttgaaacgtggttcgccattttccagttcaaaccagaccataatagttgctttaatcatttatagtactcctcatttgttggtgtaggagtactataacatgctagatttgttgtgtaaactggtggaagttaaaatcttccatgtcgtaagggcgagatgacagataccacccatcattgaattgggatttgatgaccaggccagagtcttttgcgaacgcatcgcgtccagcaaggaacttaggagtgaacaggacggcgcctgtttcatcttgtttggtgtcgaatatgattattaagtctgcaagcttgtgcccaaggaatggacctaggttgattccccatgactttgccggataatcacctgtcattccagtgttcactttgatgtactttgatttagcttgatgggtcttgacttcaatacggacaccatctttagctacaacatcataagcaaaagaccaaggattttcatgattctcgcgaccggaaggcatgaagccatgaacagcattcattactatctgttcagccatcatagcaattaagttgcgacgtaacacatcttgacgattctgagatgggtctttgtctaatgaatagttagccgtattgtgtgccttatctctagctaactgagtcatatatctagaagtcattttagtaggctcgaggcgctgtagtatcgcccaagtatcactgttccgaatcattttcgtccttaggtggatttaaaccctgtgaatgagaaccattgatgtacacatcttcaacataaagtgttccttcatagcaacggtcattgaagttcaatttgctcttatcaagagtactgaagtctacgccaaaatagaggtcgttgcaataaaggattccagcgccatgtttaatctggacatctttacaatagacgttttctgcatgatgattaccatgcagcgtagaatgtttaatgcctggtgtcaggtcattcatagggttaatcatatttacctcagaatcgtgcgatacgtttttcaagaatatgttggtatgcactcattatatcaagctgacggagaagcaattctttgtctacagaatcaagagatttgaaaaccgcacctacagtaaatgaacgaagagcattaattttaagggttaattcagaatgttcatcaataacacgagattggaaaccagtcatttaaggtccttaaaaaaggggccgaagccccattcaattagatttgatagccacgaatttcagaagtaaatttctcagtaacatcttcgagaacttcatactgacaagtacgcatcttggcatcaccgtaatcaaccggaatacttactacatcacgtggatgaaccttaactgatacgacacgagaagtactgcagctaaaatgtttgatgtatgacttagagcaaacatgcagaccatttgaacaagttacttcatcgttatcgttcacacgagtacgaggcattttaaccgtctggcctggactattatcaaatgtacctgagtggtggtctttatagtcagaacgaacaactttccaaccgataaaatgaccatcttcagtgatttcgatatcgttcgcaaccaggaagtcaaacagacgacttacagctttctggcttgggttttccagcagattttccaggaatggcagatagaactcgaagtcttcacctttgttcatggaatcaaggatacggtcaaccaggcctgaacgcagttcgatgtcctgataatacagagtaccatcggcaatacgaacatcacccttaatgaactctttaacagcacgttcgatgttaatggtgtcacgagccttacgtaccagttcctgttcttcagcgtaagatttacctacagactgacttaagaaggcgaaagcggtagcaaaaccagggtggtctttatcagcgttccaagtttcacgaccctgagtaatagagatgaacttggagtttgcgttccagatgaaagaaggttctggagctttggcttgttcaactaccgccttagcgacattaacagcgcctacggtcagagttacatcaccggtaatttggacagtgccatcacctttagcaatgaaacggccacgagaatcacgagcaggacctttcttaggagtaaaggtttgcttcgcagcacggttttcttttaacacgcggtaaatagtatcactagacactccataatcagaggcaagttcagcataagttttcagtttagcattatgaatacgaacaattttagctttatcaagttcagacaggattttaacagtcatttacagtttctctttttaaagggcgattactcgcccatgatttttacaatttcagctacagcattgccttccatattatatcgattacgcatatattcggagacaacgatattttcgccttcaaactttttaatacggtctgctgcacgtttgtcggcatattcatttaacttacgtacgatatgcaacccattataaacttggtctttatggagcggattcgtgtaagcaataatgtttactgggttcaaccaagaccttaatgcaaacaggtctttagcttctttagaagttttaccagactcagtgagatacttcatcaagaaacttagttcaggatatttctcaatatgtctagtgtaattataagctcgtccgcttgtagcagtatagtaatcataatcaacttcatcaaccaactctacaaatttatcactgatcgcaatcagcatatcttgacactggtccaacttaataattttcttctgaagctgtgggcgaacaatatggaactctgtgatacctaatacatctgcgcactggcaaataccaccaaagttattccatataccatattcagattccattgacacgtagttatggccgttcttaaacactacccaaccttcgatatcttcggcatcggcagcattatagaacagttcttcttcagcccatgaaccttctttagttttgtaccaacgaactgcgcttggtgcttttggcttaggctgatattcacgttgaacaaccactacgtaatcttctacagcagcaaagaattcagatgtgtacttaatagtcacagggtcttcgcccatttgaatcaatacgtcaggtaaagtgttcatttccagttctgattctgggttaacgaacagaacttcttcaccacgtgcaggcagccatggattctcttcaagaattttcttggccttttcatctttagaccaacgaatctcagccagagcacgaacagccggcagacgttgttttttgcaatcgtcaataataatagtcagagatttacgttgggtgccaaacatataattaacaccaataccacctcgaccaccgttagacttcaggcgtttcattttagggtctgaacagatttcgtacaccacaccagcatcaatgaaacgactcttaacatcatacttagcataaagctgattatacgttctgccattacaaagtttctgatgggtgttctgaagcatgcgatttgcattataacccagaccacctacttcacgaacaaccttacgttcatgggtactttcacgccattctttcaggtcttcttccatcacgcgtttatcaagattaataacacgagatttgatgtttgcgatagtctgttcatcaagcgacaattcttcacgcgatgctgcgatatccaattcgcctaatgggaacttaatgaatacaacatcattacgagcgccaacccaagtatcaccaagaccaggaacatcattcaatggataaacgatagaaccatatactgcaaacaaaccagaacgttcttcataagtgtagtcggtgtctggaattgcataatactcgtcgaattctgggaagaaacgtggctcaagtttagaaccaaccagatttacttttgattcgccaaacgggcgaacaacatatttgatttcatctttccaacgctggatatctgctgtcttaacaggaaccgtaatttccagaccagttttgtcatcttctttcatatcttcttcgaacagaagacgaataacaggctcaccattatccagcatcgccgtatagccatacactttaccttcatgataagaaacaacggtaaacgtatctgtgtaactaaacggagatttagaaccaaggcctaatgcaccgatgaagtcattagagttgttcttagttgatgcaaagtaagtcgtgtacaggttttccagaccatctttagacagacccggaccaaagtcacgaataatgaaacgtgggtccatctgacctggtacgttaatctggaacgcaccttcaaaaccattcagtttatgggcatcaagacagttacatgccagttcacgaacaattgcacgaatcttgtttttatacagaccagaagaaaggattttaaatgcttttgcacttgtggtgattttaaacttggtgtttgcacccttactgcccagtactacttcatcatcgccttggataatcatattaatttagtctcattcacaatgttttttgataagttctgccacttgaagaagttcatctttagtagcggtgtctttaagtattttattacgaatttctttgaagcataacttaaactcaatggccaagtcgatatcaaagaaacgttctagaattctatattcacggaaaactgcgtcatcaaataattccagattgacattataacttcgcatttggtaatacctcatgttgcttatactcaagagtagaaccaatttcacgaagtatcttacgcatgttacccatggaagctttgtgagtttggtcatgataaatcaagttcagaacactttcctgttgttcaggagtgagcgcctggttgtttttaatttgaacggcaatagatttaacagcctgagcatacgcgcgcttcctgttggcatcgtgtgtgctattcttggccttacgtattcccgcctccatcaccaccaaagcaaggttatctaaattaactatgctgttgtctgacataaccataaaccgttcctatacaaaaatgggatgtagctattacaccacatcccttagaaagcattaatggcttaatggaccccatccgccttcaattttataagcttgcccacgaactttagttaatgaaccatccgggttttctactgaaatagtaacatattgagcaaagagaggtttctcttcagcccaaagatatccaaattcaccagtagctaaagtaatccaatattgtttcatatgagctccttattacgaggcaaaaatacctcgtaatatttattaactcatccaggccttacgtggcgcagggtctttacctaacaacatctcgaattgttctttccaatcatccggaagttgaacaacatcatacttaggattcataatcatctgcttatattcagatttctgaagtgaaccaagtcctttaatgtatcgaatagaatgtttaggtaatttgtctttagcagcttcatattcaggcaggtcatagaaccatttctgttctttgccaatctgagcaatgataacaggagttttaacaaatcgtactcgaccttctttataaagctgtggccattgagtaaagaatgcaagcagtgacggataaatcgaaccggttccatcgacgtcggcatcggtcatgatagcaatattacgataacccattgaactgatatcttcatcgccaatcgtcaggcctgtgatagcacagatatcaaaagcttctttgttcttcatgatatcaacaccagacataccccaggtgttcatgaacttaccacgtaacggatatccgccatgtagttcacggtcacgaacttcaatcagataaccgattgctgagtcaccttcagtcaagaacaatgttgtgtcagcatctttaccgtaaaggtttgctttaatatgcttttgaacttttgctttagcagcttttttattggctttagtttcggcggccttttcagcggctaatttacgagccaatgctgcttcaacgataggcataataagaccttcgtctttcaaaatagcattagcaattttcttggcatcgatttgaatgtggttacgaatttcaccgaaaggtgatgtcaaacgttctttagtctgcgaatcgaaacgcatattgctcatatcacgaatgaacatcaacatcgtcagacattctttgacacgtgctttacttacttcgatacctttatatttcttcttaatgccaggcagaagatgttcacagatatcatcaaacacacattcaacatggtgtccaccattcttggtatgaatgttgttcacataagtcagatgacggaaaccatccgggcttgttgcgaatgccatagaaacattatctgtttcttgaataacaacgttttcaccgaattgtttagcgaactttttaaagttgccatctactttcttaccattgaaagtaaattgaataccaggatatataacggccagagtttgaaggcggtccagagtaatcgcatgatacatgtcattcagttcattagtttcgaaatgttcgaaatcaggaataaatgaaacgattgtgcctgttttagccttcacatgttctttcttagaagcaggaaccgatgcccatgacttgttttccatgccattagaacaacgtacgacaatctcattctcgccatcacaggtagcgccagcgaacataacagagaagatgttggttaaactactaccgacaccgttcatgccgcctgtcttacgctcagcatcatcaccgaagttaccgccggcttttgggatggtccatgctgctactggtcctgggatttgctgacctgtctggtctgtaaccatcgcttgtggaataccacgtccgttatcttcgacaataactttattgcctttgatttgaacgtcaattttattcgcaaacttaaagtttgtacgaatagcttcatcgacgctgttatcaatgatttcatcgataagtttcactaaacccggaacataaggaacaaatacatatgaaccgaacagaaaacgttcatgctgctcatttgcacttgagccgatgtacatcccactacgctttttaatatgttcaacgtcagacaatactttaatttcgttcttaatcatttcatttcctcatgtagtaggagaataatatcccatctcattaaaagcagaaaaggagcactaggctcccttacattttttgcatcgtgaatcatgccattgcgcagcagacattccagaagctagataagcacgaaattctttctttgcttcacgcttttgtttattcgtcattggaaccggccgataatataaagatgctttaccgcttactttcatagtgaaaataaatgctgcactaccgttatatggatgtttaccatatgattcatcgattttcattattcgaacctgatagtagagttcttaaacagcataccagaacaaacgacacctttaacaggaatacctgtaggacctttagccgtgaagcctgtagagaaagtatctttacttgaacaagccagccagtcatagcctgtcatttgaatatcagtaaagccattagcagtcagaacacgatacgcattcttttcgtctgtacaaccagacagaataccaattgacagaattacagcaatcaaacccattacgaatactttcatttcttggttaccttaataattttaccgctgtggagtttaataacccggctttcgccggatttcataaaacgaatacgtggtttagtgcccattagtaatcaccacttttgagcccatcataatgaactgctggagcagaaacaacgcgtttcatttcgccttcacagttcaggaacttgcaaggctgtgggttatcacgttcagaaatcttaacattcttttctgtttgttcaccacatgcttcacatttataatcatacagaggcatcgataagtcctttcaacataatataagcggcgtgggcttcttccatattcgtaatggtcagacgaatttctggaatagccaggagattaggaaatacagtttcatcttcaggcttaggattaagccattcaacaaagaaactcattgcttcatttttagtaatatgacaggaataattaatcgaatgtgcttcgctcaattcggctgaagtgataacttccccaccaagagtagtgaatgtattataaattccttcactctcggaataaccaagtttaattggaccgagcttatcaaagacttcaataagcttggcatttgcgccacatgcactcatgaagcctgcgcggtcgccaataacaaaatacttatctgccggtagaatattaatcatttgaacaccatattatttagaaattcaattgctttaagtcgagtcatttcatcttcgactacgaaacgaatcttacctttaacttcaattttaggagattcttgggtcagttcggctacatcacgtgcgatttcagccatgatttcagcatcggtttgaccacgatctttttcttgctcttcaatctgttcatcaacccagcctgcggtaggcatttgaatttcatcgcacttaccgagattaaacttattatcgcgttttggcaaatcacgaacaatagagtcgccacgaatgaaccctgaacaaataggtcgtttccactcttcaaaatgttccagttcgtctggagtcagagtgaagttcaggtatttatggtttgctctgttatcagggtctacgtatttaagacgcatggtcttaaggtcataggcaccactcatacaaacactttcgacgatgaacgggttataaccaatttcacgaatgaactgaatattgattgaagagcctttcagcagagctgcagcatctttcaactgataagcggcattaacacaccaggccatatcatagttgatttcaaagtgagtcagctcgtttactgcatccagatggatttgagttctttcttcagcatggttttcaactacttgagcgttaccataatcatctgtttcgagaactttgaaaggacgaccacctacaaagttggcgaacgcacggttatcaccgcaacgtctggtaaacagagcatggtcatgcatgctcttgaaatgatagaagtaaccttcagtgaacttatgcattgtaaacttccttccagtaataagcgccatcttcagtgatttcttggaatacaccgtacagaggtatttttgattccactgtttcatacacatagaaaaccgtagtatggctcaagtggtcattccaacttttttcaacaacaaccaggtcattggcatagcgaacatcgtcaaactggccaccggtgatgtttaaagtagttttagctttcattttgttttcctctcgtttgttggtgtaggaacataataacatgaacctacaccgttgtaaacacttagatgtaagaatctatagtgtaagctttagggcctgcgtcaggcacacgtttcatagtacagattaccatgctgcgtggtactacagagaaagttccttcgtgaacgatgttcagaagttcaacgccttcttcaagccactggtcagatacaaagccaccaatacgagcaccggtatagaaatcttcgaacactacggcacgagtcagcagatcggtagggtctttgataacaagaggcttaatttgggtcagatacatatgagccacatcttcatcaacaacgtatccaccgtttttagacggatatgtgcttgtaggagcatcagagccaatgacttcagtcacatgttcaggtttaacataaccgacaacaccaaagtccgtacgaactttataaccatcacgagcagaagtaccaactaccgtaccagtttcgccagcaattttagagccagacaaaaaagatacgtatacgcgagaaccaattttcataatcacaccttaaaataaaataaaatcaacttgaacagcatcagcacgtttgaacataacctggctgtcaccgagtagaacactattatcatctacttcgtatatagcaagatagtaacctttgttacgaagtgaatcaaaatcacaatcatcaaaccatttgtagaaatgaccttcagtttcaaaaccgaaatagaacgctttatgccaacgtttaggcaactcttctttagtttcaacattaaaatgcgttagcattgaagcacatagctttttgtcagcacccggaggtggtcggttgaaagcacctttagagtcttggaggtgacggaaactgccttgctcaataccgtgaatatccatccatatgatagtggcttcagagttatcacaacctacccaaccatatggagaacgaggttctttgttccatgattggcgtggttcttttcgtgggacaaaacctggttgcatccactcattcacacaattcctgtctgaccaattcagaacattaatatcttcacgacgagtacagaattttctttcaacacgatagatacgcatgatgacctccattagtaagtgaggccatcatatcatgctctaaagtggttgtaaactacccacgtgaaacaggtagagaacgtgggtcaacgttatcaccttcagggcattcatcaaggcccatagcgtaacgctgagcaaacttaagcatcagaatgtctttagcacagtcatgaactgaatcgtgtgctacaaagccatccagggtgccttggaccattggagtagtcgaaagaccacgaaccatagcatacgcttcaattgcagttcggatatcacgctggttccagaacttcaccggttcttgatggaaagtatcaatatcttcttcggcaacaccatcagcacgataaaggtcgcgaatcaagtcaaccagaatagggaagtcgaatgacataccacgacaccacgcttgagatttccatgggtcgacatcgttttcacgacaataatccaggaactgcttaatgccttcaagagttgacacatcatcttcagtaggagccaagttagcacgagcttctgcagattgttctttccaccattttacggtgctcttaccgaatagacgttggcctttttgttcggcaagtttaaacttgatacgtttaccgcgattaactaaagtgtcaaaactttctactttagatgggtctgggtcaaaagcaataacagccaagtcgatgacagctgctttgcttacgttgccaaacgtttcaaagtcaataattatatctttcatagtttacccatttgagcaatacaagtcaattctttaacaatattatcgcttaaaataatatcaggttcacagcctaatgcagaagccaattcaatagcattatcacatacagtacttgcctgataaagcacttctaaaatagattgtgattgggaaccacgattgaatttttctttatcattcatggtattataagcacagataattttctgtgcggcgtattcattaattcgtaacattctaacctctaaacataataagcatcatgacgagctcgtgtaagccctacgtaagccagctgtttagcaagatttgcttcagccatgtgaatacaaggagtatagatgaagctattgttcacactgataccctggcttttatgtattgtactcacaggaagtgcacgcactttaaggaacgtacgtttaattttccagaagtcgtcccaaggtggacgcttgcctgctgctttcatttcacgatatgtcgtagctaccttagccaagaacatatccattttttggtattggtctaacggaagaactttaatcacttcgattttatattcttcgtccgggtcgattgtctcaacttcaagagcccaatagttaatatgttgtttggtcgaaacgttgcgagcaattaatggcatgcttgttagcattgcatctttaatgcgaaccatttcgccgttgttgaaaactatttcgctgaattttttaccgtcgaactcgagctctttaataaatggttcttgcataacgataacttcattattgatgaacggagtttcagtttcatacaacttgcgacgaataatattgttcagcttttcgactgacttatttgtgaaggccagcatacgagtttcgaacaagtcttctggagatttcacaacttgaaaatattgcatcatgaaatctttcagagcggtattacttgcaaactcatgaacaccatgtccatcaatagtatgatggcgcaaccacccaccagtacgaatttcagtagcaacatcgatgataggagcattagaacgcattacctgggttagatgaacctgtttaaaactcggatgagtaaagaacggagaaatctgaggagttccatcacttcctggttctacaggctgaagctgttcacggtcaccaattccaatcaatacgcaccaaggcggaatagagttcagaatgattttgaaaatcttgccgtccaacatcgacgcttcatcacagactaatacgttacatttagacatatcaggcatttcgcgttgttcaaacacgtcctgatcttcatatgtcatagggttaatttttaagacgcggtgaatggtatttgcttccataccagacatcttggctaatacttttttagcctgatgagtcggcgccgccagaacaactcctaacacaccattacgtatgatatgttgaatgatgaacttagtcagggtagttttacctgtgcctgcaggaccatttagagtcagtcgttcgccatttcgtcgttgaattgccgcagtgatgatatcaaaagcttctttttgcccttggttcaaatcttcaaacttaatactcataccaacttgacctttttaataaacagggtgttgaacacttgggctttaaatttaaattcttcgttaggtaagattttgcctgggaaattcatttcctttttccagaaccaaaatccggtcataacctttactggtttaggattcaattcgcttttaagagtttcatgttcgtcatcaaaccatttttgtgcaatttccttataaggagtaactaccaccaactcttggctggaataacgatgaaataaaggcagatcaaagccatctttatctttgtaatataaagcatatccataatacattttattcacctttttgaatcattggaaggccacgctttaaacgaacgtagttgtgagcgttcatgtattcaaaacgaagcaaagctgtagctataataccataggcctgggcagcatttttagctgttttaacttttgacttagggtcttctttagccttgttcatttctttttcgaacagaacaagaagacgagcagcttcttcagttcctgaagcaatacgtttcttgagagtttcaattcgaaccattgtggcttcgtcaatgacactagcagcttcaaggtttttgagggattctttacgtccttctacattctttagaacccgaagacgagtaaggtggaattctttggcctttttaggaactataaacgattcaggctggtcaagatttttcaggcgttcgtcagccacgcctgaagcggccatgagttgctttaaagacaggtcgccgcgccacaggttgtatttcaacttaacaggaactacattgcctttaacatagcctttgtcgttatcccagcgttcaagagtaagtttatcgtcaccgctgccaaacttttcacctgaataagcacaatgagtttgaagaaggatattctccatatatgctcggtcaaggttaaagtccttaccacgagagcgagcagattcacgagtgtgagacagacggcgtttagcttttttctggaatggcgttaatggttctgtagacattttgtttctccatgttggtgtagaagcatactaacacgttcctacaccgttgtaaacactttcttgctttttatttccgtagtgtataatggttctgaggttctaccattcaatcagttccaggtcgatgatagtataaacggtttcaacaccataatctttcactgcttgactgctacaaatacgatacgttgcttccttcggaagcataaactcacactcaccttgaaccatatctaacttatcttcacgttgttcttttgcttccatctgacccatgaactcttcatcaggcgcagccaacaaaatctgaatcatttcttcttgataattgaaagcatatggacagtttttgatacggaaaacaatttgagaatcatagtgccactttgaagcaaattgtttagctgtactgaagtcagaactaaagcttgttacacgattcagtgtgaatgtttcaccttcagccaagtcataaattttatttgcttcaagcaatgaaatcccacggaataatgtaggaactgtagatgtcagatgcttacgtacaataggattcaatagctcgtgaatatagtcggtattcttatcgttcatgcacagccacagaatactttgctcctgatcagtgaacttttcatctacacgttgttgaatgtaaagacgttctttttcttcttcatctaaaactatctgtttgatcgtagaaacttgaagcatgatgacctccattgtaagtgaaggtcatcataacatgagaggaagggcttgtaaactacctaaatatgcccatcgggataccgaagactgcgatgtctgcagcctggcctagaggagattgtgtttgactgtaagagcttttgaaaggttcaggctttttaaccttttcttcaatcacttcagtttttgctttagatttagcttcaattcgcttttgctcggcaagtcttttcctatctacatctaatgtagaggtaggtatgtttgttaaccaattcatcatttcacccaaggtgcccacggtggtgggtcatcatagtaagacgcaaggtcttgcaggacggcgagagggacactgataccatgtttctgaataatcatatcaagttcatcaacaagttcttcacgcgccgtcctaggcgcttcaggcttcagggatgattctgtgtctgggataaccagcatatcaaacaaatccattacatccaccattcacggataagagggcgacctggcccgtatggctgacccatttcaattgtcttacgcatattatcagattgtttccaatccacatatgataatgaagactctgcccaaaatttataagaaaagtatgataagtcgtcctcgcattgtacgataaatttttgtctcatagctttttcttcagaatcataagcaaaccatccaatagcatcacctgggtaaatatatccatttttagttaaagacgtcataatgccccaagggcatccggatggtaaagtcccagtgtaattatgggctagttcaaccatgatatctttaggtaaaggaatctttttgaattcttggacaaggtcttctattttacaagtataacggtcgccttcaacaaaagctatttcgttaacaatttcatcttcagcccattcattaccacgttcatcaggctttttaagcttacgagtaatgcgtaccgcataattatgaaccactgctgtcataatattttcctcaatttaaattaatcgcaagaactaccactagacccagaatcacatgaagaatatcctggatcgtatccacctgtagatggtgtataactaggagtagaatgcaacactgtaacaggagcaatcatactcatatgagtgttatctgtatagcttcggtcgtaatgggttgcagtcggtgcagttccagtacgattagggttttgattacgagctttgcttaaagctgctgcacttgaaccagcagttgctttaggaaaagggtcgccgcgcctgacaacttcttccatcattccgtcgcctatatagatgtattccttttcttcaataggaaccatacgctcgtgcggctgagcaggagaaaacaggtcttttataaatttaatcatgatttaatcctaaaaaggtcatcggctaatgctttagcagtttggaaatctatttcattctgcttttctttagctaagttcagtaagtggtcttctgtttgttcattgaagtcattcatagctttccagaactcgtctggttgtgaaagccaatttttaatccaaggtaaaggattcagtttcatattttcctcacttagtagatgattcattctaccacctggtttaaaagcaaaaaaggactcccgaaggagtcctataattagacgattgtatcttttaagaaggatgcgaatagagaaccacgacgagcataaccggcatcattaggatgcacaaggtcatgtgaagtatattcttcagcattttctttagtaatccagccttggacatcaacaaacttcagtgaatgcttttcagcctgttccattacagccgtacgaatcttattaattgcttctgtttcaccttgtggcgtagcaggaccaattaaaataactgggaccgtagggaaattagttttaacaatttcaagagctgcgtccatattggtcttaagttcttctactctacccgctacagaatcattatagcctaagctaaagataatataatcaggaactctagacagtgtcagcaatttatttgtaacacgagttgccggaaccctttcgccagtagaagtccaacctgaaccaccaataccatctgctaaaccatctacgcctaaatggtcacacataatacggaaatcgttaaagcttggttgagttgcttcagtaccgaaggtatatgaatcacccatctgccatacgaatttacgagtacgtggaggcttagacaacgtatcagaagatgaacctaagttcaaaccaccgaatgcactgttaacacctgctaatgaatacgagcgtgatttacgttcaccaccccaatcaactaaatagacatacgaagcaccagacgaatcagtagttacactctgtgtgccgactcttagcccatcaacataaagctcacaaatagtattaagacctgctaatttaatttcaaatttaggagagtcagtaacccagttagctttaaactgtgtgccatttccggtgccattcccacgatatccagaagtagaatcttttacatcagaaccccaataatcaaaagcagcatcagtacgttctttagaaatgccagcatacatagaggttgcgttagtaccacgataagtaaggttgaatgtagcgcctgtccctgtcgttatattagccccattgtttccattaccggcctcagtagcacaagggttcgtaggaggggttgtatatacaccgccttgacgaacagaagcagttgttatagcgccttcagcacctactgcagtaacacgaattaatgttggggaagttttaactccaccggaaacgtgaataatgtcaccaaacttataaccagtaccgccatcaacaattactgccgtatctaaagcaccgctgcctttataaaggtttgttgccggagaaggagaaataggagcaaatggagggataatttcaggaagttctgggataattggcggtattacttcgccaaacattacttcgatattatatttttgccattctacatcttgtcctttttcaaagaccgtagaatataatggttcttcactcaaagaaaggttataaaaagagcctgctattttatgtgcatttgaatacacggtaaaataaaccgatacttctatacccgatcttaacttcaaatttatatatttcatattggttccctttgtttacaagttatatttatttaatgctgtgcgtaaacaaaaaaggactcccgaaggagtcctataatcaaccacctgcctcaggttcagccggaacaccgacaaacatcgcagcattcttggttgcccaatcttctgcagtttcaactacatctgcataagcaggttcttcagatgggaaaatttgatagtgtgcaccggcaatacgatgtgcatcagaatatactttaaaagcaacagaaacttctacaccttttacttcgccagatggcagagtgtgatcgaaagttttgatatttacataaccgcccataatggactccttttagttggattgattacaggcgtatttattaccgattaataaccacgatcttggcgagcaaaattctctgcatttttcagatggtataacttgtaaatttcttccgcgtccataccaagagccatgaatttattcaagaagaaatgaagctggtcaatgagctcgaatttaatttcaagctggtcttcaggagacagatctttaatctttttagattgcatttcaacatgccgtgctttccatggtttccagacagcagacgcttctttttcgccattgctcatgccaccaagtgcagtgtacagttcacgggtttcatctgcaagataatcatcttgtgcacgcaaccaagccaaaacttcaccagcagtttccagtgaatctggatgacgattgctttctggtttgtctttagccagacgaacctgcagagatttctgcatatcaagcattgcctgcagtgggtcttcattgccgcgcagcataccgtaatagcgcccagtcgcctggtctagagcggctttatcttttactaattgtgaacactcgttaaaatgtgccattttatttcctttcaattcaagtagagattaattataacattattattttgaagcaacgaaaccaagctcttcagagatattacggaaatgttccatcttctcaaattttgtccagacagcatctttatcttcgacaaagtcaaaatctgttttaatacgaagattcaaaaggcaacccatgatatcgttcagttcatctgtcagacgttggcgatttgttttgccttcatattcagaatccaatccgaactgaataatcttagagcaaagcattgcaacttcattacattcttcgcctagttttaaaaaggcatgttgttcttggttcatataaataccttcggaggatattatgactactaaaaagaaaccgttattcaaattgaataatcacaaaaagaaagtgattatagtttctgtaggtactgttgttgtattatggaattttatcataattccggttgcggcatccaatggactggttctcccaccagtgtcaattgaacacctcagaactgctgctactttaatgctaggattttaagcacgagaataacgtgacagcctcatctttgccattaacccctgttcagtattcttgttcatatagtcaagaatttgttcaggggttgctccatcatctttaatcatatcatttatatccttcgaaggccatggagccttgtcccagaataaaatcctttcacctgcatttacaagtttagtcatacgtttaatggtgtcaggatgtctagcttcgttatccatcacccagacacgggtctctttaaatgggactgtatttaagtccatagagccgcctgttatcgcgatagaattcggtatgaataaactatcaataggcccttccatcacccagacacgtttacgttcatcaactgtgtcgagtccatagatttttgttgcgtcgtcatgtgctttgattgtgatgtatttctggggagcatctttgcgtagagctcgtccttggaatgattcgatgtctttgttgctgttgaagataggtataaccaaccgcggttcattcgtttcattactgtacgtcccaggtttcacagagttaacaagagcaggccactgcatagtaaaccataaccgatgccattggttctcaggaatgaacctggaacgaacatatttgattataggatggtctggttgtaatttgtcaagacgagtacaatactctaatttttcgataacaggcatctttgctttaaacttatcagaaacttcaacttcttttctttccggcttagcaaaagtcttttctttccttatctcaagaatatattcccgataaaggtcctcttcaaattctttcaagtacttgctcaaccatgcatcatattcacagttaaagcagtgaacacgtattcctgaatctttagcaggataagcccagaaacgagctttattcatgtctttttgggaatcaccacaaactttacaacgacagtttaatttgaagtcgctcccggttacttgtctgaatttaggctggtgagataaagcccttaatgcaaattcacgatctacaaaactcataatggtccttaaactaaaaaggctctcgatatgagagccattatattatacttcttcggacttcttagatttttgcttcttagaagggatttgttcagggcctttattaactacagcgcctgaagtggttcctgaggcaatattctgaggattaccgcccgcatcacctgcaaccatatcttcgtttagtttgacaaactctttatatgttttcatagtcacctcggcctatttatagacctataatatcacaatgaatgccttcccattcacggagttcaattgcttcaacaacgtttttacgatgttgtttctttgcctgacgaatctggcgtttagttggacgggtatggaaggtaaagatatccacatgtccaaacggcaaattagtcttagactctgtatcaataaacaattcccagatagctttatgttcatattccgccttagtgccagggttagaaacataaggtggtgaatacattaagattgatttcatttcttcatccagtaattaaaaatttgcgaatcaatatcattctgaactactgtttcagaataaagaatatcgtccagttcaaacccagcgcaaatataatctacttgcatccacccttctttaagctcgtcaatgagatcttcatcaataccagaagtagccgcaagttcaatacaaatagctttcaaattttcaggcgtaagcttacgaccgtctggtggcaaatgattgcgcccatcaatattagaatggtcgatatacgtacatacggtatttgttacgttattaagaagaacagttccgatccaaactatgttctcatcataaaccttaagtttacgttctacacgatcatacattaaaatgaataagtacattagtcaggatccacgaattctacagattcttgaggagttttgccttcacagacaaccatctgggtggcaactaaaatatctttaaagctgtacgactctaaagtcattgcacggttcttatcaactttgccacggaaaatacctttagcaaaagcacgaagttcaggctcatcaacttcagcagaatagatgcagtccggagagttatacccgctttccatttcagaattttcttgaagttcttgttgctgtgctgccgtcatcatattggcaacagccatagagtttgcaaacgatggctgggcaccgcatgcgcttaaagcaaatattaaagacagagttaaacgtttcattcttcttctccaaattcttgttcataatcgcaatctaaacaagttgcattatcaaacatatcaaaaactgctttatcttcagtacagctacaaccacatactacacactcaaattcttccatttagatttcctcgcagaaggcccatttagcatgataaaccgtagcacctttagtatcatttaaacaaaccacatctaccggagaaactacacgatagacaattggttctcctccgtatgaacgtgcagcacgtccagcataaatctttgctagtccgatatcttcggtgaagaatacacggtctaaatttttcttacgtcctacttcagaaattactccagtatcgacaggcggacaaagcatgtttttgatgtttgcattagttgtcgagccatgatagtaagttttcattttgttctccatgttggtacaaggctataatatcacgccctgaggagatgtaaaccccgaaaggaggccgaagcctcctcttagaattttaactgacctgcaagttcatcaaggtcacttcgattgacacgagcctgtctgttcgcttcagcctgacgattcatctcgcctgtggcttcacgtacagtagagataggtcctttaggtccaccttcatcttctacttcaacccatcgttgattgcctttcttaacaccaatcttgaacttattatagtagttcttatcgccataacgtgacttcaactgtttaaccatttgaagacccatctgtgcgaactcttcggtctcaacaataccaagcataaagtctgccgtgtgtgcaataccaaatgattctgcgatatcagccatatcgatttcagctgaaacgttagcacctcttgttgtctgtgctgcagtccacatgacgattttcttttctaccgccaggccacgaagttcttcagctaccatcttaatcagaccataactgttttcagagaacactttaacgcggcttgaagcacaaatagccaggtagtcgacaattactacatcaggaacaaaaccttgtttcagtttatattcattcaacaacgcacggaatgtatctgcattagcaccaccagtaggatattgcttaatcttaagcttacctaaggttttggtctggcgccatttatccatcttagctttatattcaggccaagatacgtgcccttcatcaaggtcatcaagcgtaacatctagaaggttagcatcaatacgcttagcgcatacttcttctgccatctccatagagatataaaggacatttaatccggactgaagataatcagcagctaatgaacaaagtccaagagacttacctacgttagtccctgccaacagaatattcaatgtaccgaactcaacaccacctttagtgattttgttgaaaatattcaggcggaatgggaccttatttgctttattcatgtatgtctggaaacgagcttcgctatcttccatccaatcatgaccaagttgtgaatcgaaacaaatagacagtgcatcacgcatgatatctgggattgcaccaatacctggcaacttacggttctgttcatgtggtggtaggtctgcattagtctggatttcgataatcttagacgtcgcattatacattgccgctttctgaacatacttttcagtttcagatactaaccaatcaaaatcttcaggacctgcatttaaatcagaaagaagagctttagtttctttatattcgatttcaccgatactagcattgctcaatgcaatatctaatgcgtttttagaaggaactgaattatattcgtttacatgagcctttaacaatttgaatagggtctttgcaggaccctggtcaaaatagtcagcattcatataaggccagacacggacaaaatagtccttattgcctagcaactgtgctaaaattgtttctaccacttccaccaccttttcttcatattaatttcttttagagcttcgttaatttgcattgtaacacatttttcaacgtgctcagctaattcgcctttacgctcttcggaaggagtaccaaaatctacggtcacttgaccttttggagaaatatcaatctttgtaacataaaccatatggctgctaccatctgggagtgttaacaaaatctcctgcataacagaacccatgctctgtttaataatgtctaaagacttctcgtaatactgagggccactagggccctcttcggtgtctttgacaaagttgtccagatcggacaggtctaagtcattattcattatcttcttccatttcgtcaagagcattctcaacatcggctgcagatggtttacctttcttacctaagtcaggaattttactcgtggctttagtattaagtaaatcggcaactgcatcatcaacttctttaatagaagagattgcaccaagtttgtatttggtttcaattgcatcacggaatggtttatgcttaaacaaaggaccccagaattcaacatcatctgtagccttagcacgccaagatttttcttcctgaaccatttcaccagtttcttcgtcaaggaatgaacgagcataccagccggcttttggcttaacaacaaaaccgaggtctgtagctaattcaagcagaccactgaatgggtcaataccacctttaaagttcacagtaattgggaacgtggatttttcttgaacagtacgagacttttcagctttcagtgtgaagtcataaccagtgagttcagtaccatctttaatctgacgtttagagatatagaataccgttgacgcagaataaagaataccagtaccaccacccatgatttctttagggtacataccaccaatttccattgccgtatggttaatagctacgcacggaatatctttaatagtcagatatggcgttacgatacggaacagagatttcagtgatttagcacgagacatatcaccaacttctttttcgtccagagcatcttgtgtttctttcttagatgcagtgttaccgatggagtcgatgaagataataaccttttcaccacgctggatttcttccagttggttggtcatatcaattttcagcttctctactgactggattggtgtgtgaaccactcgttccaggtctacacccattgaacggaagtaagattcggaagcaccaaattcagagtcatagaacagacaaattgcatctggatatttcttcatataggcggcgaccattgtcagaccaaacaaagttttaaaatgtttagatggcgcagcgaaaatagtcagaccagattgtaagccagtgttcagaccgccacccagcgcaatgttcaacattgggatacgtgttgggacttcgtcacgaccgttaaacagtttagacttagtcagatcggcggtcagtttagtagtagaagctttaatcaggcgagattttaaatcggacattatatttttccattggtcaccattatatttttctcacggttagattagaaggtaattatatcactttgggtttacagcacgttctacacacgccttagcccattttttattattttgacgctcaaaaaacaataaagcaaatagaccgcctaggcctaaaagacctaggctaataataaagattaacgggcccatttgataatcttagtgattaatgcatcacgttcgccagcgttaaatcctttgattcggttatcaccataatggttcaagagttgatagatttcaacatcgttatctaaagcaaattcttcaaacaattcgataactttattaaagccttctgcacttaaagaaatcaaatcatcttcgaagtctttagtaatttcattacgggtcagaatgataggcaatacattgttttcattacaaagacggcggaagtcttcttcgtattgaccaagttccatcgaaagactaccacgcaatgcgccataaacccaatttgaaatataaccacggtctaacagataaatcttagacgggtctaagtacttcagcattgtttcaaaacaagctacttcattacgactcttgatgtcaaatcgaccttcacaagtacgttttgggaattcaatcttaacgtaacggtctgagatttcacagatatcacgaataaatgtcgttttacctgcgttatctgcaccatcaactaaaataatttttgttttcattcgttaattaccacgtcactatacataggaatattatatggcgaagaaatgaaagcaccaaaataaatgaattcagccaagccaggatggaataccttatcagggttttcaaaatactggatatgtggacggcctttcagtacttgataatattctgctttagacaatttagtcaaacgaatcacggcttcttctggataatgactgcggtcgaaactatcattcggatcggtgatataaaccggttgttgagtctgaatcgcgcattcaacaacttgattgaaacgatagcactggtcactgatacggaatggatggaagatgccatttacatgtatcgcttcaagacccgcagcgtagcgctcgataacgctagggcgcacgaccttctggtctacgataatcttatagtcatcagccccgtgtttaaccaggacgtccttctgacactgattcaatactgtcgtatacttactacgatttactgatgcaacatcttcttcaatgaattggtcgatatagaaaagaggcttttctgggttcattgtgatgttaaagttgaaccataccggatgacgacccttataacctgtgatatctgttacaaggccaacaacatcataatattctactaacgagtcaacaacccattggttttcttcccagaaatatttacgagtttcgaaagcattttctttataccacagcgggacaaattcgaactcagggaacagttcacgaagttcatctgcatcagaagcatttttaggaatagcgataatatcgccagcacgagcacggttcaaatgaagctgaagattgccgtccttcagaacggcatattcaccagtttcatgagaccgcatactataaattggtacgcggagatgtggcattagtctaagaatcctttaacataatcgaagtcacgttcaaatatatgagcagagaccatagtgtgagtgtatgtacctattttaacaccgcattgttcagcaataaaggccatcagcttgccttgcagatagaagtctaactgcataacgatagcacagttttgtgaacgcatatgacaatgtgcatgaagcttaccatcacgaatataatacgttaccgaatctgtacaagggtattcaagggactcgtcgctatccaagagcgcctggtcttgctcttgaagaatctggaacacaactcgacgggaattaggcttctctttgagttctttaagaagagctgggagttgcgcaacgattcgtggtccgtagaaagtattaaagttcgccggtaagacatcgctttttggtttggcaatgaacttagcaacatttggatattccttaaatgcttcttctgcatccgtaccacctgaaatcatgaactgccagaatgcttcagcataatcataatcaatacgagagatacgtttgtcagacattttaaacgttgatgggtcttgaactactacggtcatagaaccgatttcattacaacgacctatacgtgaatcagtaatgaattcaggattgtctagaatttcacggttaactgctttgaatacatcttggaactgtggaaaattaaaatatttcattcgattgtgctctgacataatttacttaccttaaaaatttctctgtatatgcatcttaactcaggagtcatatcagctaatttctttgcttcaatttctaagttttcgataggcagcccatgtttctttttaatacgtcctatcccatcggtaatagaaagacgctctaataaaagaacttcaatttcattatcgatggcttggacctcctctcggaggtcatcaagttctatcattcagggtacctcgttgcatcatcactattatcagtgatagaaacgatttgaatagagttcaatggcatatcattcttagacaactggcgtttgtaataacgttcgcagtatgtacatgtagagccacatacttcattagcacaatcaaacgtagggtgtttaaaccagcgtttctctaagaaaccatcaagtaatgaagtctcgatattaacagtatggctatagtttgcatcagactcattattgtaaatggtttctagtggcttccagagctcaaggagattaccttcaaatttctcagaggaatatgcctctaatactttcatgatgtactctgttgaccctgtacgtcctgacactttaaattgggtgataccaatatcacggtaaagttttaggtcctgaggacgcacaaaacgcgtgcgtaaccagttgaaagggtcggtgtctcgagctttaatgcagtgctgcattggataaccgtcgagcgattttgcatcttctgcagtaacgtcggtactgtggaaaatatagcaagaatcgcgataactacaatgagttgtatagcctttgcccgcgttagagcaaaattcgttaacaaggacttcaaagataataccattttcattacagaatgctgcggcctgcttcaagaaattaaccgaacggtttttatgaataccacaacacactttcttaatattgtattgatcatgaagatatttgatttgagtaacagcatcaacgtgcaggatagttgatacctcaatttcaatttctttattcacttcacgaacaatttccattactaccgggttagcaatagtaattcgccagacaccaattgaccatagatattgaacatattcttgaatggaggccttcttccattcggtgagttcacgtttagttcctgggttaatgctgttcaacgtatagttaaagcaaatgtcaagttcgttacaacggcgaacataaacttccagctcttcatcttttacatcaggcagacggaaatcaggacgagcggcgacaaatgccatcgctcgtgtacttccgtaaacttcgttaatcagtgattgcggatttttagcattcaactcaacgattttatcaagaagtgccaggtcaaaattggtgccgattttaaatgtattttgcattttcatctcttttaagcaggaaaaggatgcgatgtcttttgcaggctattaaattaaaggtttggtttataagatttaaaagtttcgaattcgcctttattcataaggcttttgaattcgtcaggacgcatagctttgtcatcgataatccaatcatacactggtttatgtgtcagcaattcatggaatttcaaaccgatattagccaggttctgaagtaggccaggaagaatatcaactgcaatacgcccaggtcctacagatttcataccgcgagcggtataaagtgttatatgatgtccttggtcataaagagcattaatggcggacaccatttcgatgtccggcttgaagtttgcataatcacggttatggttccattccgtgatgcaatcgtctacatcaaaacatagacgaagcatattttctacacgatgcattatcgaattcgttcccattgatgagtgatatcgccgccaattggtttgtagaccgcaccagtttctttatcgatgagttcccacttatcactgttctttgtaataagagttgctgtgatagcttcaggcaggtctttagcaaccgtaccatcctttaacatacgacccattttacgtaactgtttagtcagcagatacataccgtaataatatgacgaaaccgctttcaatgggttattcttgaagtaaccaccaagtgcaatccagataatcgctacagccagatgatggtgttcattaaacgtgtccatcttttcatatttgtgaattaatggctctatatcaatttgtgcagatttatttgcttcatcaatagtcaagccaccccacattgggtctgcattaaaattgtcataacctgagattgcataaagcactttagcttcatcatacaggcgtggaccgtaaatcttactgttgccgaaataaccacgtgggtcaatgaacttaacatcgccttgggtggacaccatcgtgttactaaagtttgggtcaccatgaatgacataatacttacggtcacgttgataacgaacaagatgattcaatgcttgtttaagcattggtttcagtcgtccaatcttcacatagttcacatgggtaatttcgccaaaactatcaatcactggctgaatactttcacaacgagaaattactttgtcatgaaattctttcttaaagtcaacttccatttctttatggtcaacatgcttgcccattgcatcttcaaagcgaagagcatcaagaatgttatcaaccatcgtgatacgagcaattgatttcaaagtctgaatatgttcaaacatcggaagaccatgaattcgttccatttcaaattcgccggcttctttattgtagttaacgatttgaggaattgaattagaatgaaccgaatagtaccacttgacttcgtcctcttgaagagaacgaccttgttctgttactgcaattttggttacagtatcttcgtttatttctaccgaattaaaactacgattcagttcacggtcagcatgagcattagccagtttaggtttatcgcctaaatcgattagatttagcagttcagattgacgcatcgattcaccataaacgaaatcaacaaagtcacgcccttcacaatggtcattgatttcttctttggttatacccatgaagaattcccaatctttaaactgataaatgcctacgacattaccgcctgttgcacctacattacgaagtgaataaccatcgaaattataacgacattcgtcgcccttagtataaatcgcattttcaccccaagaccatgaaccaaagtctggaataatgtcacaccagttcacgacgacattatgtccatctagaatagggtgtaataatgctaatgcataagccgagccataagattcatccacagtctgaacattaatcttcaagccttcttgttctgcataagcttcaaccatgtcctggaatttagaatgcacgacaacaataacttcgtctgcacctaaatcagtataaatggtcgctaagtttttgagaatggtgtcttgtttatagttcacaagcactttagggatatgatgagtgattggatataaacgagtagccaacccagctccgagaataacagcctttttcattttgtgttcctcattaaatggtacatccattgtaccataatttaattgaagcaattgtatttggcctggagccagagcatacaccaacctatggctaatgtaggaatcattactggtacagtgatagaccagtaaattgttagcccgaagaaggctaacaataagaatccagtcaagtacttcatttgtcaccacggagcattgcgccaagggcaccgccaggatggaagcgcaggaaatcgtcaggcgtaaagttacgcgcggatgaaaggttaattgcaaaggtgtcaatcagagccaagagcaacgtcgtagacatcgtaggcgctaatttattatcatcaacctcgatagccttacctgtacagaaggtgtagtcaaacatcttcagaatatcagtactcaggtctgggttacaatgcagcagaatctggtttactccaggacgaattccacgcaaatggttaacaacgcctaacatctcttcagttttacctgaacgggagatgtggaccagcacatcattagggccaatgaaacctgcatcaccatgagagtaatgaccggtgttcaaatacatacttggaataccaagcgaggccattgtttctgaagccttagtggcgatgttagcgtttttacctacaccagtgataattacacgaccttcataattagaaagcccagggacgctcagaacactcaggatttgctggtagttttcataatcagaactcaccgcagaggctagtttgtctaaagcaagagactgaagaaatagtgcgtattttgctcgttcaattggatgcattacgttttaccctattacattcattttcggttttaagggctttggactggagctttgtgtagctctttttccaaagatcaaaagctgtactatattcataagatttacgataatcgcttcgtgatgggcgtttatcaataagtttattatattcttctttgaacgtatcattgacaaaacgctcacaatattctgcaatacgagtgttacggtcaatttcattgttctttgctacggcacgaagataatcttcacgtggttgtgcgttacgacgttcttcatcaagcttggctgctaattcggcttgagcagcacagttcttaccgcattgatttggagctctggtatacgtaatgcctgtaccgttacgccattgaacttcgcccgtacgtgcatcaacttcagcctgagttctaatctttcctacttcagacgcattgtatataggcccttgaggcatctggcacccggtcaaaagagtagcagctgctattaaagcaattttaagtttcatttttaatcctcaaaaagtgttaggccattttatcacagcctaacacatttgtaaacttagaaatcaaacatatcaaacagacttgctttcttttcatagtcaattttagctgcatcagtgaaagcagttaaaggtttgacgaatgttttctggaacaacgtgttgtagtccatccaagccagaacctggtcacgaatctgaattggtagttcaattcctgaaggccatgcaatagacgtttcaccaaatgggttaccttcacgaagtggaagagtataaaccttttcaccatctacaatttgtggaacagtgaggtcgcctttggttgctcgcatataagccagaacacctttgatatggccagggcatttatagccagggaaaccattatcattgtatttctgaatgttgtttgctgaagatacacctgcgatgctgatataattcagttcattgaattctttgttgaactctttgaaatattcttgcagacttccttcaccttcttgaagcatacgacgaatacattctttcagtgctttctgaacagcttttggagtacttgatttctgagtttcaagacccatgattttcagttttggttcaacgaaacgagtaccttccatgtcccatacgttcagggcatatcgtttcttgccggtccagaaaccaccaataccatcagaaccaagtggtggtcctgcgatagcttctcggtccatgaacattaagtgttctcggttgttcatatattcacacatttcacggaagccagcatcaatagcaggttccatacgttcacgtgcaaacttatctaagaagtcgacataatggttcgtgtcacggaatttttccattcctactttctcaaggattttatctgccttcacataaatggagtcggtgtcaccataaagtacgaatgcttcattttctgtaccaagagttttgttcagatattcgttaaccttacgttcaatccattgcaatgccatctgaccaaaggttgtgatagccgtagcatttcgaaggtcataataacggaaccacacgttaccaagcgcaccataaagtgagttgataagcaacttacggttaatctgagcagtgttacctgcaacttcacaacgttcggctttgaacaacattgattctaatgctttctgacttaattcgtgaagtttagatttaacttcatcattgaagtcgaaacggtaatcaacttcaaattcaggcttatcacctttagtcgttttcttggcttctttaatgagctcttggttacgctgagcagccagcatataacctttatgttctttacgctgtttaaagaccttagtgatttcaaccggaactacgccttggaagctcttatcatacatcataccatttggagaacatgaatacacatcagatgggcgtggagccgtgccagcaatgtattcagctaatggatgtactttgaactgccctactaatgtttctggactgatattaacttgacgaatgatacttgggtacagagatgtcaagtcaaagctcattacatatttgtaagcgttcggaatcggttctttaacaaatgcaccaggataaggcagaactgggtgtgattgcatttgtggaataacttttttctggtctttaagtgagttaaagatgattgcgtcccatgttttgataggactaaacacagattgaatctgcattttagcataataacccattgacaagctcaggttaatgaactgtcgtttcatatcaatttgaataacacgataaacgtcaataatgttataactgatataacgttggtggttagtttcacgcaacttagaaataggaccatcgtatggcagtttaccgaccttcaattcaaattcagagacatagtctaatgaataagatggttggttggtgaaactaaatttcttgtacaggtcgatataatcaagcatactaatgccgtacagttgaataatctgacgagcaccaccatacatactttcaacttctttaatacgaacacgacggtgaggggacagacgtttagcagtcttttcactgaaggtattcttcaaacggttatacacgtacggcacgtcaaatgcctcaacgttccaaccggttaaaacaacaggagtcttttcttcccaaaggttcagatattccaacagaagttctttttcatcgtcgaatggcatgtagacaattttgtctgcgatttcttcaggcagtgcatcaccaccttcttcttcaagtttacgagccagtttcaacgaccattctttgacattaccatacgggccacctaaaaggtcaaacacatagaacttgtcatcgatactatcataatgggtaatcgcatcgattggatgcttggcttcagctggttcagggaacccgtcaggagatgttacctcgatgtcaaagtttgctacacgaattttagactggtcgtaatggatttcaccacgataagtgtcgctgatataagccaacttatagtcgtccatacctaatgcttcaagacccatgtcgtccatacgacgcatccaatctttagcatcacgcatgcctgggaaagttttcttgacacaatacttgccatagatatctttatattctgtaggctcattagagtgcatgaacatacatggagcataagttacttcacgaacttgttcgcgaccattactatcgatataacgttcgaagatactgtcaccgaattgttcgactgtcaaataaaattcttgcattggttttccttttggtttatagtccgagtgattggactgttggtactgccattatactccgaacaggagcccgtaggctcctgttgctatactacgacaacttcattagtgattttgtttccacgtttaacaaaaactgttatagctgtgccttctttaacaccttcaaataccgcttgttgaatttgatacgtgatttgctcatcgggtgtaaggtcgaacaatgttttaccttttgggacttcaatcatattagttacctattgtgtattttgatttcagtgtccattcatgtttctgtttgaaagaaatgacacggaagttatttgtcagttctttcatgaatgaacgttggccttgagcaatttcaatcaggccccaatcttcaagcagccaagtgatagaatcacgacgtgtttcatcttcttcagtgaattcgacttgtcgtccatccatcttcagcatttctttaaagtgaacaatgtaatatttttcttgcttatgaagaatatgacaactctgataaagaaccttatctttattgtttgcaatacccatacgagtcagagtttctttgaccttcaagaagtcttcaggatttttcagtttaatttcaatcatgttaccattccaatgctttctttttcaaatctttttgttctttaacattcttggtcacatcttttaagaattcgtctgtgacaagccctttcatcttcttcaacatcgcaggaagatgtcctttcaatttaagagtttcgagataacgatgtgcatcatcattgttaatagaatgaaacttcatcaacaacttagtaatgaatacgatgtctactgaatcgtcgtgggccttagcccacttaccaaatctcttacccttaggtacagcatgaagcaaatagttaaaatgactttggtcatcaagcttcaaacagttgaccattgccgactgcataatacaatcgacatgttggcttagactattatcaatccagaactgattatagttctcagattgcgccaggttacgttgtttcttaccgaatgtaatatcattcattatcgcaaacaattcgttctctgccttctctttaaacgaatctgatagctcttgaactttatcaaagtcgcgttgtttccaagcgacttcatgttcattcagttcaacatcatcatcaaaaagacttacagccattggagctccagagcaagttgaatgaaaagataagtcatgtgaatttcagggttagcggcgatgccgtgatactgattattttcaccgacgatttcatacattctaacaatgcttggtccaggcaatttagtatacaactcgttagccaatgactggatgaagtttgcataatcgtttacatgacgcggagccagcgcacgaagttctttaaagtttttatctttaagagcagcgacaacatcatcgataggagaatttgtattcatcacaatgcttagaataccactatcgattttaccgttagccgcataacgatctaattggttaatagttttacggaagtctgggaagttttgtttaaccaaagcggcaataactttaaggtcttcaacttcaacttcttcattcttacaaattgcaacagcacgatgaatcatttctttcatcattaccgtttggtcagccggagttgcttcgccaaacttaataacacgacaacgagattgaagcggtgcaatgatgccatcaatgttgtttgccgtaataataacagaacagtttgaagaataagcttcaaggaatgaacgaaggtggcgttgggcttcagctacacccgcacggtcgaactcgtcaataacgattactttacggcgcccttcaatcgattttgaagatgcgaatcgagttaattcgttacgaacaaaatcaatacgacagtcagaaccgttcacaaacaacatatcagagtttgtatcattacatagagcttttgctacagtggttttacctgtaccaggacttgctgaaactaaaataaggttcgggataagccctttatctacaattgcttgaagtgtggctttatcatgcgaaggaagaatacactcggccaaagttcccgggcgatatttctgttcgaacataaattcatttttattgattgtcaacatatcattttcctcagttagtttcacttaatactccaaggagaccgaagtctcctttattttaaaacgaatggctagagccttcttccattgcaataacgtaagaggcttgagaaccttcaaacttagcagcaaactttttatcagcagcccacagatggacacgataatcagcaggaatcatttttaggttcgttttgttaatgatgaatttaaaatcaggaccatcatgatcaccaacaaccagagaatacagctgacggttcaggtctttgtcttcaagttggttatgaccatcgataacgattttaccatctttagcacgaataaccagcgtatcaattttcagaccgtttgaagcacgcagcagctgttgcaggtcttcacctttaagatcgaaaataaccttagccaccgggaaaggaattttcttggccgggaacacaatagtgcttgggtcagccactggccagaagattgtagaacgttggtcacgaataaccaggttagtttcatcttcacttacagaaacttcagcagaatcagaaaccagacccagaatagacaggaagccgttcaggtcatagattgccgcttcgatatcaatttcatcattgatttctgcttcgccataacttgcacctgacacagaacgagtcagaattgtattacctggacgaagcataataccagagtaaatggaagagaagtttttcagtacggagatagtatctttagagaatttcatttaattaccttttattcaagtcagttaattatacaacagcttcgattacagccatttgtttcttaattgcagctggcagagattcgatgaattctggaatactcgcagcaataatttcagcagcctgaataagttgttcatctgcatcaacacaatattcatcttcaagacgatcagcgccaacagagtcaattacaaacttagcaccagcagctacactgtcggcaatgtgcttacgcatgatttcgagccatttgtcatttacttcatcatcaatagcttcataaagcatgaatttagtttcttgtggcagtgattgcagtcgagtagcagaatcagcgtcacaatgcagaacccatgcacgacgaattttgttttggttgttagggttagaatcggtacgaacgtttttaggttggatatcacgagcggtaatgccgattgcagaagcgtatgtcatattatttctctctaatcaagttattcatttaacgtggtaattttaacataagtaattgaaagcattcagattaagctattcaattacttattcacttacttattcaaaatactcatagacgaaccatgatgtatttcttccagacattatcttatcacactcgtcaagaaaagcatctctcaacattttttcagtaacaagatgataagtctcgttgatattgtttactaacacatatcgttttaaatcaggggcagccagtaagtgctggcctgttgtaaattcaattgccattattccatcaccgtgaaacgacctactttcttcatttgaagatgttggccatatgcctgtgggtcatggtctctgtgactgataatgaaaatgttcgtatctttaagactattaagaatcataccaatagttttaacaccgtcggtatcagtagccgaatcgaatacctcatcaagaatcaacgtggatatattaacaccacttacctgagaagcaatatcacgccatgtaaacaacagagcgatatcgatacgagccttttcaccttggctaaagctgaaatagctaaagtcttcacgaccacgagatttaatcgtttcgttaaattcttcatctaaagtgaatacataatctgcttccatgattttcaagtagtggttaatcttcttgttaaacattggaatatacttcttaatgattgcacctttgatgccagaatctttcaacatctctgtcaaaataccacgatggtatttttccataacgagcgttgtcttttctttaactaatttatcaagctctacttgaagcttagcaatctcatcagcatgactaatgaattctgcagcagcctggtcaataagaactttaactttcttagccttttctacagcagtgattgcagtagatttatgagcctgaatttggttcttgatttcacgagctttaccttgttgagcatgaacttcatcttgaattaatttcagctcacgatattgttcgtttattttatctaaagatttttgaagctcaaagtttttgtctttaattttagtcaagacattaccatgttcttcaagcccctgcatacatgtaggacaatgcccaccggtctcataaagcttgattacctttgtgaaggttgcaatatcattcttgattgcgaatccttcattgctcaggtcactcaggcgagcgctagggtcatcatcgatgataacggcaagtaaatcatcagttaacttttctatgttcgccttggccgccctggcttcacttactaagtcatcgtacattgtctgcaaacgagcggcgttctcaccagataatttcttctgacgttcttcgttgtcgttatagattttaatctgttgagtgataccatcttgcttaacatcaatcacctgaatctgagagttcgtctcacgaatcaaagatttgttcaacttatccatttcagcaagaatacttacttcgagcaagtcctcgacaagttttcttcgagcgggagttgacaatcccatgaaaggagtatatccagccgttccgagtacgacaacctgtttgaagcttgaataagacattccaatgagctgttcaaactgttcttgaaagtctttggcggaggcagattcgtcgagaggtttaccgttaacactgatttcgaagacatttggtttttgtccacgtttgatgtaatattcttttccatcaaattccatccagagttcgaccaaaaggtctttcttattagaactgttaacgagctggcctttcttaacatcacggaatggtttaccgaataaagcaaacgtgattgcttcaaggaatgttgacttacctgcaccattcttaccagttacaagagtcttttggaccttatccagttcaatagtgatgggcgctgcgcccaccgacataatatttttatagatgactttctttagcttaaacgttttcatgtattattctcacgaattgtttgttcagcatattctaacatttcttcagaagaagcgaacacaccatcgagttccatggcccatgaaacaccttcagaatattcagatgtcacgtacatagttcctgtataccaagaaccttctaccgtccaatctatattaccaaaccagccatcaccaatatgaaattcatgattatacattttcgctataccattcatctttaataagggtttcggctaattctaatacgtaagtaggagtatcatctggatatgcattaaaactaaactctacacccatgtctgtggtaacatgataagcttcagcattcaattcatcatcgaatttagcatcaatactatatttgatgtaaaaagtacagtcaagatgttctacataacagacgtgctctttgtgcatataagagcccatgaatacatcatatttcatttactcacctcaatataaagttgtttagctaaagacttcaatgatttacggtcctcatcagaatgaccatccggaagagcgtcaatatagtcttccatcaaatcaagcaatgacttgatgtcgacttcttcatcgctatcattatctacactgtcatcgaccttcgaaacaattctaagagaatgaactactttttcgagttcactttcaaacttaggtagtcctttatcaacttgctcaacaatgacacgaactgccagatttttaaattcgtcgtaattgattgtttcgttgggataactaatcttacggtgccatgttgtagaatttgggacgaagtcaaacgtcgctttttgagtgtcctgaacccagaatcctcgaggatcgttttcgtcgcctgctgtaagcgtccatggtgtgccgatgtatttgacattagctgcgctagagattgtgtggaaatggcctgaccacacttgtttgtattttttgaggaagtctggttcaagcccatgagatttcattcctttatagaaatagaagccgttaagttcccaatgtccaatacaatattcagcagaacttgtcttgatgtgttccataatttcggttgtgttttcgtcacacatccatggaatcaaatcaatcaacgtaccatcgaaatccatcgaaacgggtttttcgataacagtcacattagaatacttaccaagaacttcttgagccgcattaggagtcaatgtgttcttgtagtgcatgtcatggttacccacaatagtaatcagatgaatacctgcttcagccagttcttcaataatctgccgagcgaattccatacacttgtgtgtaattgctttacgtacgtcgaaaatatcgccatattggataataattttgatattgtgctttttagcataagcaatatgctcacgaataccctttaattggatttcttgaacccatgggtcatctgctttcacacctaagtgccagtcaccactgtgaataatcttcatatatcaagcgccgtcattgcaatacaaaataaaattattgagataagcccgtcaggagtagaaaagaatcctatccaacaagctcgtgtaaatgtgtagaatgccatgatcaacacgacatatcctaaaaataattccataatgttctcctcagttggtttattataagctcccgaatgtatagcagaaaagggaccgaagtccctttaaattttcttgtacgtgattgtaccttcggctttagcctttgccaatgattctttgaatcgtctcattgcttcaaccttaccggcacgaaccttttcataatcaggtttagatgagttctgtgctgatgaagacatctacatcctctgcattaacaaagaattctgaacaatcaggttctcttaccattgataccaccttttaacttgggctgtatcaacccaaacaacttctttaggattagccttaatagctgggcctgtgtcacctaggacacgatagtgggtttcggataacttgacagccataacaccatcagccacagacaaagtgaaccctgcgttaaccttgagacgcttaaacggtttttgtaccagcattgataatattccagatttgttgacgagtagtttcccacatagtgacaatcatgtcgtcggtgtaaggttgacgatagattttacgcaactttttaattgcatactcatacgccggataattattttctaatacagcaccttgagagtgcaggtccaaacgttgaatttctcgtttgttctttttaagaattgcatctgcctgagctgtcgcttctttagcatttgcttcttctaaacgcttctggacttcttcaatttgttcatcagtcaattgagacaggctgtcaatcattgttattccttaggagtcaattcaatatcgagatagaacaaatcatcaattaaatgataagaatattctacctcattttcttcactggtcaattcaacgcgaccaggatttaatgggtcaattgaaatcggtaaattttcaacgtctcgtaagtacatcttaagcaaatacggtaatgctgatacgtcgtcaccgatttcatctagaaacccagtgaggttaatttgaagcctcatataaaaaatccaattcgccttctttaggttcgtcgctcttatcagaccctggcgtcttaattaaagaagtttcatactgcgtcattttatcgtagatatcttggatgaatgtttcatccgccatgcctacaatatcatcgtcacctgcgtcatagacgttatggacgaagtagctgtatttctttgccatttctttacgttcttttttgatacgctgaacgaaggcattaaaacaagccattgttatatacgcatgtgggttatcatatttcgtttcatcgaagttatggagacctttaatcgccgcttcgatgccgtctgcaatcatttcttctttccaggattgggtatatcctgagaagttgaagcgttttgacagaccttgtgcaatgagcataattgccaaaccaataacatcattctgacgaacgattttgttagggtctttattagctcggagcttttctttccattcggaaatagcttttaaaagctccttattatttacataattgtttttggtcagacgtggttgttccatataagcctctttactcaattcataggtccattataacataggttgagggacccgaatttaaagcatcaaagcttacgtagaatctggtacatttcgaacaaccgctcacagatgttcaggaattctttataactgaatggtgcttcagtgaagccaatttctttcacgtattcagtgagctcacggtacaaacgttcataatgactatggttcagctcagacacatgccactgataactgtcgtctgcctcttcatatgggataaaatatactcccatgtagctgtcaacaacgaattgtactgtaccatagtctaaagctaattgattgcggttcatcacattacgtccttagcataatcgacagcctggaacaccgtagcgaattcgtcacgatattcataatggttttctttagtttcgtaaaggaaccagcgcccgaagtcttcttcgataataaagttatcaccttcgaccgtagtttgcccttcatcatttttaaccagatatcctaagagacgaagattagcgatatcatcaggagttaatttagtcattcaagtattcctcaaattcatttaaagacattgcttcgtcccaggccagatgaatattaagatctgtcaaatgaacacaataccgggtgttcacagggtatattctgcaaggcctatttgtatcatctaatactacataggcattagatatggtttcataattttttagaatttgggtctttcgaaatttacctttgtctttgtaaattagaataacacccaccttttccgggagcttattcataatcgaaatattcctgtagttctgaaacagttaagccttccatccacatttcaccgatcgttggctccttccaatcatatttgtgttcagtatcacccatagggcgtgggtagatacgaaggttatgaagcttgccttcaacaaacaactggttaagttcaataggaccgatataaccatgaacctttgaaacttgagaatgccagaagctgaccctttcaagtttcagaacaacgaatcgagtacctaccggacatccggctaaatttaaggctgtcattagcttgctgccttaacaattttgaggtcacggaagcctttcttacgctgagacttcatacgcttgatagtcttttcagaaatcttgtttgcttccgggtcataagtccctacaccaaaagctggagtaccaaactcagacagaatataagctacaactaattcgcgaatacgggccttaccgattttctggtcgttttctttcattgtaccatgaagctcacgttcccaggcgtcgagaatttcaggagtgacaatatctttattaaagaggtctttagccatcgcatctactttagggaatacgaaagagttcagaacgtttttgatagcttgtgacataatgatttcctcaattaatattttgttatccgaggaggacattataccctgtcctcatgggtttgtaaattaattactatttttgaaaaacttattagctttacgttttgaagttcggcctgttaaatcactgcactggttttcgaaattcttagtagcacttttattgtcattgcgttgttctcggcgctgggcttttttcacatcactgctaacaccattccagcgcttaggtttatcagaatggaagatgttattagcaactgtgatatcagaaactccatctggagctttgcgacgacctgcccagtattcacctttaggatttaaatctttacgacgaatagtcttacccattttaattccttatcaattaattttattgattagaggacattatatcctgtcctcagggtttttaaactagaaaattcttaagtggcgattaatcagccaccctagatggtcggcttcaatttcagttatcttaataccgatttctttaaagcgattttgaagcttcaatttgtcattacgcttaattagggccaccttaggaccataagcgagttcagcaatgtagccattttcaggagcagttgaccaaagtgtgatgaagactactttttgttcatcaacaatcaaacgaataatgtttttgacttcagaaattttaatagacattagttcagctccagcagaatggcacgaacgacttgttcaacttcggaatttaacgtatctgaagctaaagcaaaaatacagttagcaatacgctgtggatttagtttggcttgctctacgtaacattcagtgcggcagcttagtgcacggaagataatttctttgttagcaatttcaacaacaagattgtaatgaccgtgacgatttgctacacggaattccatacaaactgatttagttttagaagtaagagtagccattaaatattccccatgataaatttaactacggcttcagattcataaacataaacttcaggaacacaggcaaatactccggtcacgatacgttgcggatgtgctttagcttcttttacagatatttcagtttggttccacttatgactcaaacgaatcgttgtagcagtgatttcaatatgaagctgacgtgggcggtcgttggtgttaacttcaacagtagcacgaatatccacttctttgcttaataaatgcattttgtatctccagtttgttcgttttgttggtgtaggagcatactatcatgatgaaagggtgtttacaacaccctttcaaagattaatcttctatgatgtcagggtcaaagcccttatcgaggaggagttgtttgaagaaacggatattgtgaacgagcttgtcgtctacgaatatcacaggatagcgtatattgagagtagggaaccctgcacgcttagctaatgaaactataagaggtctgtcgtaagtgaaccctacgccgtcctgagatggcgagagcacatcataaaacgaaaatggaagacctaagccttccaaaatcttacgaacatgaatacaaccaggacagcggcttaccgtctctggaattccgtagacctcaatctttagtgattggttttccacgtgtaataccaccttcatatacccatgaaccgagttcttgatattcaccgtcttcatcttctttccatagactgatttcaataaggaaacctgtatcagcgaactggaaatagacagaaggaagaaccccgtgttcagaacttacttcgttaatttttgccaatgtttcttcttcaccgacaaagaaatctgggttcagtgtacaaccaccaaactggtaaccgtcaccgaggtcgtcccattctttccaatcgattactgcaaattcttcaaaacgtttcatttgtcagcctttttcatggcttctgctttagcttcaaccttggcgatagctttatcgatagaagctttgaagtcaaatttttcgccatcgattttagggtcaatataatgaatcagcgcagcaacaataacaacaggaatcatagcaaccattgcatatgccatcagaataacaaacagaattacaaccagatatttacggaactgagtcattagcccaccattttagttagagaatcaataagaagcattgaatgcaatgcagggaattcttcgcccattttcataatgagttcatatgcatcacagagttgagtattcagccaattcattttaacgatttcctcagttgttttttgaacgaagcgaccatcttagtttttgtatcgctttcgatataagtaaaaccatgttgtttgaacatggctatcatatcatctttattaccacgagcaaattcttttgctttatcattgacaaaattaggatgaatattgttttcgctataatcggttttcagatagacgagcaaattctcaagccattcgaggtagtcgacattttgacctttaagaccagagcggttgaacttatgcttcatttgtccttctgcagcattacacaaattacacagcaacccacgaaccttgccggcttttggtccgtttaggtcgtggtcgtggtcaagatggttagcttgaacatcagagtctaaatctctcttacagattaaacacttgccatgttgtgcatcataaaatttttgtttttgttctttgtatagttttccagtcaaaagcataagttcaccccataaatagatgaacttatttatgcttagaaagctctatcagaaaaagctaattgtttttcaagttgatgaatataatcagctgctgcctgcataagatttgcttcataaccgtttacacgagatttagcttcttcaagacgaacagtaatttccataccatcgaattggttcataggaatttcagggaacagaagcaagctcttcaatttctttcaactggtccattgtatcttcacaatagaaacaccagaaccaagagtcacgaccatttacatgaagataaggaccatccttgattttgatcaaagtgataccatcttcatagtcacggtcacgttcagcaacattaacaaccttgaacacaacacccttcttcaattcagggaactgcatttgcagttcttcatcatcagagatgatttcaaatactttaccgattaagctcattatcttcttctcacaggtttatcgtgaataacgcagtggatagcacccactagtataatagcagcaatacttatagcgattgcaagttccatgtttcctccaggtcgagcagttcgttcactgtaggttcatcataacactcttccttctctgtgtaaacaggttcttcaggctcgacagtttcccatcgagctgcataccatggcttaagcaagccaagaacaacttacttcgaaatcaggaccaccgtattcccagtaccattcgcctaccggcttgtactcggtgcatcctgtttcaggattagggacttcttcatagtcgtcgcattcaaggccaacgaactgccactggacacgatacacagcaaagccaatagctacatcgttctcgccccaggcgttttctacagcccattcgatacctttctctaaagcgagattggtcatatattgatacaggcgtggctcgaggtcattttcagaaccatcacctaaattgataactaagtctttcatttcaattgtcctgctacagcacggaaatcatcgaaaccaccaagatggttatcgttccagaaaatttgaggcatagtgataccaactttactttcacgaccaagacgtttcagaaggtcggctattacagcatcatcgaatacttctttctgaggcatcacattaacaaactcaaatggaatacccttcatggttgccaggcgtttagcgttatcacaataggcacatttatggattgtgctgtcgtagccaaaaatcgttaacatcttcgtctatttccttaaaaatttgttcgagtacatcattaaaatcaggatgcatgtggagtggatgactccaattggaataaccttgaacgccaagtcgtttacgtgcttcatggtaaatcgcattagaggcaaagttcttggctcttgtcatagctgattttatcacagaatcacttggagcagaattattctctttgtgatacatcatgaataaacgcagagcacaacgctctgcttcttccatatattctttacgttgtttagccaatttcaattacctttttatatgcttcatgaccagcaatagcgatacgttcagacatcggcagcgatgtttctggttgctgggctaactgagctgccgcattgattttaaacatgataatatcaaaatctgtcgcagcatgaatagaacgatgaacgtggtccatattcaaagcttcgcctttttcttcagcatattgaagacaaattttagctgtaataccgcgaagctctttgaacaaggctttcatttcaggcgtattagaaatcttttctttattatcaaatggattcatcttacacccctgggaaaatagttttaacccgttcagcaatagcacggtccagaacttcagtgaacttcttattcagatgatcaacaataagttgttccatacgagtttcggacatcttcagagcattttcgatacggccttcaaggtctttaacagccttttcaacctggtcgcttaccgcgcccatcacctgagaataagcaacacgatttgcttcttctttcatgatacgttctagttcgaaagtaccttcaaccttattccagcctttagagacgaagaatttattcagctgctctttaaccatcggagttacgtccggcaggcgagcgcctacgagactgatttctttctgaatagtttcttgtactttatttttactattcttcaggacgagttcctggacaacattattgatgactgcttgttgaagttcaacacgtgactcttcgtcagaaaacagcttcattacagcatttgtatcgagttttaaattaatcattacgaggctccttaggagtaatcacaatagttttatcgccaatggcattaattacatcagagataatattatctggcattggttgtacttcgcaaatgcttttagcaaaggcctcaatatccaaggccgtccgggcttttacttcttttaatttttctaaatcaatcatattgttctcacaaatttttgcttgcacgagcgacatttaaattgaagtgtcggcgtagcccattgtgtaagttgtacctgaatactatcacagaatggacaaggtttagcatgctttcgagcccattcacggcgatcagccatttctaatacggtagcccagttaatttcaggaacttcgatttcatcacaacccttgaaaggaacaggacctttttcaaggtccacttcagcccagccttcaggtaaagataaatctaaatcttcagctaattggtttttcatttacgcagttcctgcattgcatgaagcagtttagcacgttgtgcacgaatcttatctgctttacccgtgagttcatcgatctgacgatcgtaatcatcaacaacaatagtcatttcattcacagacttttccatttctttatagaaatgctcttcaactgggactgattcaggcttgtagattttaaggaaattcgctttagaagtatctacggtcagattacctttaataacttcttttgattcgtcaaaatcaggagctttaacttgtggtgctcgaacagttactgtgaatacaactgatgagccaaaacgacggaatgtataatggaacaattccgggttagtcgcattcatgaaagcacgaagctgcgcaaacgtcttttcttcaggggcatgattgacaattgtaacagtgaatttattatcatagcctgggatcattttagcgtcaagataaggcaatggcccaggtccagttttaaactcaagctcacggctacttcctacacacagacgagaaccgagtgtcagaatcatacgccaattgtagttaaactctgaacagaaactttgagtataagctttcattgttggcgaacatgctgaggtgtaatgcccacgagcgttcttacgagtaaacttcatgccttctttacgttcgccaaactgagagatacgctttagtgctcgttcgacagagaaatatttactatcacgcaatgctttatagaagtcatatacgcacagataattaaatgttggcgacagaggaggcagtcgattcatgatttcttgaataccaacatgtttaagcgcattgatatcaagagataatgccatttgacgaataaaaggtccgatatcatcaggatgattctttatcaccatagatgaatcagtgaaatcatttttataatgattagacggatgacggaaatggtttgccgctacacggcacgcttcgcgtactacaattctgttattcattttcaattcttttgctactgacataatattttcctctatctttattggctgataaataatcccgttttgaaaggaccatgattcattataccatagccctttctaaagcgttttagtcgaaaatcatttcacaaatccaaacgaatggactgatcaagactttaaggatataaaatatccagaacacaggccacatcacaacaaccattgcggctgtgtttccatcaaagtcatctaagaaccaatcgccgacccaacggaaatagaaggctgaagcaaagcctacaataacgtaggctactgcgaataaaataacttccattaggacctcgaatcaataattcgtaattgggcttgtttgtaggtataaattgcttctttaagttgagagttactcactttaagattagtgttataccatttattcaggtcttgatgctttttgtaaacttcttgaagcttgttattggcttcaattaaagcatcttggagcttattaaactgggtttccatgacttcgcgtttaacacttccatcatagttcagagcacaaagaacattagtatggcgccagagctctctgagttcgcctagaacgtttttatctttaccccaattaaacttatacagttcttcacaaatggcttcagcctgcttctcagctttacctttagccatcccagcatagatgtgagcaggtggataaagggccgtgttatcgacccagtttgaaagaataaacattaaatcaccactgatgaaggacgtttgaagaaggagtgagtagtgtcatccttagcatgttcaaacgtagctttgaactcgatatcaccacggtagtcatgtggtactgcctttggcagagaaccataaaccgtagcgccattttccagtcgaacagtcatcttaaagactggaccatattcacccatccaatctttgactgaaacaaccttaccttttactgtctgtttgcccacaggagcttcgcctttggacttattcagctcggcgtaataattactataccaagcttcagagtacgcctgaatcgcttccaggatggttttatgtgcgcgtactttacacataccagccttatgaccaccttccaagtcccatactttatatggagtttggatttctactttgttcaaagctttgatttctttgtacatatcataagtaagacgaagcttccaccaaccgtggtcaccagtatactcagacttgtcaaagttatcaagctcggtgacatatggaaggtaactaccagcgtgatacgcttccacttcacctaattcattttcccacagatatccatcgaatggcgcatgtggacggtcatcaacaccccaggtaggagctacgactttatcgaatgattcacgtccgtagagggacttgctccagcctgagttcaactcctcggcgcgtttttcaactttcgctcggtgctcaagatgggctttacgattttcttcaaaaaggtcattgatgattttagttaacattttatatctccgtgttggtgtaggaacactataccatgtccctacaccaatgtaaactacttgttcacacaatagaaaatccatacaggccacgcaaggatgcaaactaacgttttgaacgcgttacttctacgaagcttaatgcctgtgatagagatgcacccggctccgacagcaaaccatgatacagcaccaatgattctggccaaaagtacaggttccatcagtaataggtcctttcatcatattccccgccgaaccaggcactcacaggcgctttaggttgggtagcttttttgtaatcaagatgggccagatttttagcaatttggtagccacgagtagcattaatctgttcacggtccatagtaaccaaggacttcgttttcgcaatcagagtcacacgtctacgtaagtgtggcagtgtaataggatacatgcgcatctgatgtaaagctgcgttcatgaactggatatgcttaactacggcacgttccatggctttcttgaaatcttgagaggcgttaaacaacgcccattctaaacgattaatcggagtcatttaatcacccattaagtcattaatgtcggaatgatagatgtttgcttcggcaacttcttcgccatcaagagaggctttaatagaaagcgtaccaaacaaatcatcgtagttaacactcagctcgagttcttcacgaataacacgtttcacttcaagccgaatcatttctttaatttgttctgaagtaatcattggtcttcaccattgtagatttcttcttcagtatagaccttatgcttacgttccatgacatagcagtatggatcgtctatgtccatgcgctgccagaagcaacctaactggatgttcttaggagaattagtagggctgccggtgcaacgtccgcggtcacgacgagagtaacgatgaacaccgttttcatccataatggtttcataaccggtacgaccacgtccttcaaggtctttaaatttaaccatcttgactttatcaccacttaaggtttcataagtccagccttcttcaaaatactttgattgtccaccgtcgaccataacgataacatcttcgacgttttgatcggggaacgctacaccattagtttggccatgttggaatactgcctggaattcgttttcggccgcaatagtagccttacggaatttgccatcccaaacaccatctacaaaacgtttgaatttaatttcataagtccagagtttcattatgctacctgcaatttagagttgattttggaaccaatgaacactacaacagcgacagcagcaccacataccagaccacctgtaaacagatcggtaatggcttgttggcgatcaagaacccaggtcattttagcaatcatttcatgacgaagggccagttcagagttaccaatcagagcatagaacagtgaagcaatatagttagtgaacattttattttcctcaaatcagatgaacggtattatcacgtttgtagatgtcaataagcatttggcttggctcttcataagtgaatcgctcatacgctttaatgactgttaaagcaatcgttgccattaacgcaactttaataatttcagagaatacttcttttaagaatttcattaaaagagccaagtcccatttttatcaatgtaatctatccaatcgttgatactccatttagtagtatcaccttttggtgtttttacttcgtaaagaccttgtttaaaaagtatctttttaatattcatatttccaccatgatagttgataggaagactataccatgccttcctatcgttgtaaacacttacttcagaagagtaacttcagcaatctcttcccaaccatttgcatcagtagcgacgaagtcagccaggtaaagcgcagtacgtaaggacacgttacggagcttagttacattagccttcatccagttgagcgccatggacgtctgagcgtcgcttaaaccacgtttctgcatcatgttggtgttcagaattacatcttcaacacgaaccatgatttcttcgtttgagtgaacacccaggtccagataaactgaacgtgatacaagagcatgaagatgtggagcaagtttagaaccacgttctaattctttatcgatatcaacgttagtgatgaacacgatagtaccttcgaactcgaattctttatcgatgtttttgtcatcgagataagcagaagcagtgctccaacaaactttacgagtttcgcctgtatcaagtgctgctttcaggaggttaagcatatccatatcagagaatacgtcaacatcatcaataagcagaacgctatttgcatcacggttgttccaaagttgttcataaagaccaataccagagattttaccgttgatgcttttgtaaacaatttcgccatattcgtgagcagttttcagagctttatccaagctgtaagtcttaccaatacctgcagcaccagagatgattaatgaacgaatgttaccagagatgatgcctttggtcatcatgttcattactgtgaagcgcttgttgatacgctgtttcatttcctcggctgactcaactgtgaccagtggagaaacctccataccttccatttcgatgtctgatttgaatacccaaatcccacgttctttaccatcaaccattacgaacactttaccatcaccaaggtgtgcttcatgagctgggactacatctgggaaccaggtctttgtagcgacatacttaccagagaagtcgttaccgcggaaagtacctttgttgatttgaacgttgaacattttattactccgtgaatttcagtatttgtttcgatgcagctataataacatgttcgctgtagatgtaaacactttttgtgaaataaatgcccgaaagggcccgaaggcccttaacttattgtttattaatctgattttctgcaatgcgagtaggaaactttgaaatccacttcgctaaagaccacaatccacctaaaacaaacaacggtaaccatagaataaagtagaaccaatagtcagaaacagattcaatagtattgtttttgatgaatgccttacacactaagaaccctagtgcgaagtaaaccaacccgataaaaataggcataatccaccataactgagataaaagaataagacttaaattaattgtcataatcacctgtaatatgaattgtggtttgcaagataaacctcttcaaggaacttgttccagaagctcatatcaacttctttacgcattccattcttttcggcgttcgctgctaaaagttcgacatggtcaacggtatcttccagaagttcttggacatacttgaacttgaacataccagctttaatcattcgaatcgtttcggcttcacgcagtgggaataccaaatcaccggtttgataaatttcacgtaactgaatgccagcacgataagcatggctcaaagctttccagtcaacgccttcattagcttctgccttacgagcacgttcaccatattcggcttcaagcttagtcaaactgtatttgatttcagcaatggtgattgtgtcctggaatttacggccgagaacattatagaagttctgcttacccattttagagtcaacgaattcggcccagaacaagaactcacttgttggcagcagatgagcaatttcaccaagcttccaacgttggttatgagccttatctttaggacgatcttcatatttccattcaggataatcgttcagaatattcagaatgattttcaggtctgccagacgagaacccttgacaccatatttcgctgcttgcttacggacataacccagataagatttcatatctgtggtatagaagcgctcacggttatcttggataaacttccagacatcaggcagatcagatttaacaatcagattagaaggagtatgaagcatatcaagagcaacagtttctccttgctgagcgagttccaaccaatatttgagagaatagagttcatggtcaacatcctcgtgtccattcttagaagcggtgttattggtgttcatgttagtatgattcattgcacgacccataagaatatctttagggtgtggaacgaagatttctttgaaatcggtgtcactttcaggcgttgacgtgccatataaatggctaccgaagtagcctttcataattgtcttcatcgtgtaggattaccccattcaaatccagagaatgcatcgataagagatttatcgttcaggttaaccattaaggctttaccatgatcactttcaaggaacatattaccaccatctttagtgatagcaagaactttaaagaaatgacctgctttaccaaatacatcgccaactacgaccgggatcataactttagatttttcactgtgataatgagtaatcttatcaccggcaaaagaaacttgttcttgaacgccttgagacatcacagtgactttacttactttataaactctgattgaacctttagcatactcaaccagctcaatcagagtacggtttgaatataccttcaacaacagcctggtatcacgaccgccatcaataaagatggttgctgcaccctggaattcagagataaagtcaacaataccatcaatacgttgaccattatccagatggatttctaaagaacggcctgtttccaggcatttctgacgacgaccttcaacaatactaggtttaacgaacatggcttattccttatcttcaggagcagtgaagttcagagtagggcagatttggtcatgcttagctttaacaaaagcccatacgatattttcaggttttggttcgataccttgttctttcagacgttcgcgttctaattctttgtcatatttacgatcagaccaccagtcttgaatacgctgaacacaccatacaccgccaaatacaacagcacaggcaccgccaagaataagagttaacataacaatagaagcaaagaagcttgcgacataagcccaaatgccggcaataccaagaccaatcatcgggtcaaccagcagattactgagcattaaagtcaatccagtaccggtcacaccaaagaacataatacgatacaatacggcacgcatataaggacaaagtgaacgaggaacacccttagaagtagtgaaggtgtttttaacaagtttgtagtgccaagagtttacgttaatattcattatatttcctttcaaattcaagattagagaattggtgtaatttgtactaagtaatcacgcaaagcaataatatcatttttatctaaagcaataatatcgctgtcctgtttgatggtcataatggtatcaccaaacccaggctcgttggtctttttaaccttcaggaagatatcctgaacgtcatcatcgttgtagatagtcgctgcgtaacctacgccttcgtaattcagcccaactttcatttcaatttacctttagcttttgcatcatggattgcagcaagaacacctgcatagttctcttggtcacttttacgtacgatagtcatactataaggcatgctatcactatctttaataaaacgttccaactgacaagtcagaagaatttcagggtggaacaaagtatacatcagattacccgtagcgccacggtattggcaaatttctaccgactgttcacctgtatatgtacgagtcagaaccaggtcgcctacttcaagctttggaaaacccattttaatttcctcatgttgtctgtaggagcatcataacatgtcctacatacgttgtaaacacttagcggttatgcttcagaatttcatacaaagcttcgacttgttctgggtctaaagcaatagtatcttcgccttgatgcataataataccgccaggtacggttttccattcatctatttctacatcaagtgaatcgttatcagcaatagaatgctctggcttcagaacaattacaccatcttcagaactaccatatgggtcatacaaactcatctcatgctcctatgccaacagttacgtggctctcgtttaaaaatgttatcattcatagcttgacatttgatgcagtacatgcatccttttaccgccaggcgacgagcttcaggaataggttcgtcgcactcgtaacagaactcaaaactttcacggtgttcattaatctggcttcgagcatgaactactgcggcctgtacgactgcagcaatttcatcttgttcagcaccgtctttagcaaatcctacagccatcagagctccggaaaactgttcaaaagttgtttaaagcgagacaactcttcaagtttcatctgcccaccaccaaaagaagacataccactaaatttgaaggatgctccaatagcacgtccttcatgaatatccatagtgagcaatgtgttatcgtgtccattattatattcaatagaacgttgaacacttatatgcccgccaccatgttctacaactcgttcaatgatttccattataatttactcaccatatcagtaattttcttttggatttcttccattcgttcttcttgagccaaagcagttccatttccagcgtattttgctccaaacaaagccgcagcactcttgagctcataaatcaattgaattaattcaactttagcaccagtaggaatcatgttcatttcttcactccagttcgttagtgtaggaacatcttaacacgttcgaaagagcttgtaaacaccttctttaaatgcccgaaagggacccgaaggtcccttatttcaacgaaagcaaatacttggtttgataacaaactccaacaatatcgtcaagaacactatgaagcgctctaggagttttgtcataaatgggctccgcgcatttaatcatttcgtccatgaacttaatagtgtctttaggcatttgtgatgcactcggtaaagaagcaacatatggcttaccagagaagcctaaatactgttcgctgaatttatcgattagaggctggatttcagcataatagaaatcgtaagctttatgcctggcgtaactatctgtttcaagatgtgccgatttaacataagcagtagaagccaataaccaacctatgaattggtctacttcagtcccttttccctttacgaaatcattgaatttcattttctagtttaaccttatgcgtgtatgcatatgcttttgccgctgatcgcccgtcgatttcgcaaactcctgataaacaaacttcattattagctttccatcgggaattaacaaagctcaagaatttattagattcttttacactgggttccttaaattgcttatagacagttaaagctccctcgacgaattttgtatattcggcttcatttgatgttgcagaagcgactggggccataaagaccccgattagtgtgagtggaaaacaaatctttttaaggtggtccataagtggactcctatcgatttaaaatatttttctttgctgtcaggacagccttaacttgtttgaggtatttttccagtaaacgttggtgagtataatcagctttgaacctgttttctttgaaatcttgtttagaggcaccaatcatagtacctaattcacgacggatttcatctaaagattcaatagacagattacgtaattgcttttcagacaaatactgcatatacacctctttagttagttagttatatgtatttattaaagtacacatgtactctaaattttactttagtcccacatcatagaggaaacacctttctcgtatttacgagcggccttttcgtcccagttgtaatcagtatcgcttctcagcgagtgtttgatttccatcttgtgaaacacacgaggaattggtgatgcatagcgcttccaacgaagagttttccagaacgagtcacgatgacgctcagccatcagtttagacaagcgttttggctcttccatattttcagcaatatcgcgttcgatataagcttcgttacgtgctttattatcgctttggtgtttctttacataagcaaatggattgttcttttgtgcatgccatttagctgaagtggttacgtgccagcctgcacgacggatagttcttgacataagtacctcgaatagtagttaaactgcatattcgatagtaaaagcctgatttaaagaatttcatcctaaagtcaccttacatttgcattttgggcattcagcttctttaacacgaagccgtttagttttggtctttggtgcagtatcatgatcataaacatgaaggcaccgatagcaaattactagtttcatacacccaccagttcacaccaatgttttctgcacagtgagatataacggtcttcaccacctaattctacctgagcaccttcagttacagcagaaccatcttctctgattcgtgctaccattgtagctttacgtccacaatggcatacgcctttgagttcgactaatttatctgctgtggcaagtaatgctttagaaccttcaaataattcaccgcggaaatcagtacgaagtccataacacattacaggacaattatacaaatctacgattttgcataactggaaaacctgttcagattcaaggaactgggcttcatcgaccattacacaatgaatgtcacgttggacatgggcccatttaaagaactcaagcaaatccataccaggagtaataatatttgcttcttgtttaaggccaatacgagatacaatttcagtagatgaatcccttgaatcaatcgaaggcttcattactaaagtgcccataccacgttctttatagttattagcatgcgaaagcaaagccagtgatttaccggcattcatacttgcataatgaaaataaagttgagccattataaatccttaagccataatgctttctaaataccgtcgttgcttttcaagagcggcttcggcttcttcaaaaagtttctgagggccttctaaacgttgatacattacttcttgagctaactggataagtttatcaatttgctctacaatatagcactgttcttcgtcagacatagtcattataaaccgtcccaatccacgataattacattaagattaggagtgaacatatcgattaagaccgataccttttcccaatcaccaccggcaataccgcaaccaatacgtggcatataaacgagcggaggaacaatcttattagaaccccactcatttaattctatcatacagtttactaaagcaccataatcaagattcgggcctggctcgtattgtgtataaaggttaaagcaatatacttctttatcacccggcccatgaatcttagttgctttagtgtaagtaccaagtttataagagtcgccaagcaaagtatctgctttgtcgatagccagaataggaggataatattttgccaattgtcctgctactccggctcccatttgatgaaaacagttacagccatgagcaacattatacccagacttaaacaattccacgatattgccggtgatgtatttggtaatcatttagcgtttaaacctctgttataagcgtcgaccaatcggtcgaccatagacgtacatacgtctttaaattgtgcatcggatggaatgcattctgttgtcattaatcggttttcatatctttcagataaagctttctctctgtatcgagagcgggcatccatctgtccgtctttatatgagctcataacctgattactgaattctaaaatacaatccacatttgttggtgaacaataatctttagccgtacgcttggcatactccaatatatctgtcatattagacttagttacttctatttcaggatttgctgatactcccatacttagtgttaaacataccgccaaagctatttgttttaacatttaatccaccgtttgatgtagcatccttttggatttaaggtaatttgccttagcaagaacctgcgatgcatacttatttccagcctttacattattgcctgcattgtaagaagcaatggctttcctcatatcaccattatgccgttctagccaataagataactcaatataagcccaggacgcactatttttgcgctccttaatcattttgattatctctttatctgacatcttccaacccacctgcgccatcctattacgtaaggtaggcaagtaattttggaacatgccgtaagcatgatgcttatgcttttcttcacctgtatttaagcctgcagaactttcctgccaagccaaaccagccattatgtaacctaaaccgttattatcataacgcttcgatggttctttgaacttacccgacttttggaactgttcaccgaacgcgtaagcgtactgcaaattgtcaagttgttcattactgaaagtaggctctacgctatgggcagacatactaactgtcaatagtaaagttgctaatacttttttcatgaattctctcttagattaaatcaataacttttgtgctagtttttccttcaagacgacgattgttgatgaaagccatacgacagcacagagaaggcattttgcctggctgaggacggtctacggtcatacctaaccacagattgcggtcagtgatttcaagacgaagaggacggtaattgataccaggttctttgtcttcttcaacatcaggtaatgccggcatattaagaaattctacaacttctttaacatgattatgaagacgtttgaatagtgcaaagacgtactgctcatcaatttcacgttgaatagcacggtccaagaggtgagggctgtacttgacaaagaagcgttttacgcctgcttcagtacaggatgatgcaatagatttgttgatttcggcgaactctgtttcaaagatacgacgaagtttgttgcggcgaatgtaaacgcttgaatcgatagtcatttttatctccttttagtgtgtatgaagatagtaacacaactaaaaggagatgtaaactgcttattcttggaacggggtgagatttccagcaatagaacaaatttcaattaaagcaggatagaactctttaacctgttcaagacgttgttgggcatacttgagttcaccttcttctatacaggctgcctggtcttctagaagatacttatgataaccagtacaggcatcactaataatgcgttgaaactcttctaaactttcaatttgcattagtatttctcttcaggacggaaaaccgcgcgacatgcccacatacttgcttctttaagacgttctttagcaatattcaattgagccgcagcaataagatcttcattgatttgcccatgagtctggtcaactttagtttcaagtgcttcatcaagcaaggcatcgagaattaacccaagacggacttcggcgtctttgatagcgtttactttaccgattttgtcatcggtgtgtggcttataacccttaatatcttcaatcgacataaggcacctcttcattagtttctttatcgtattcgactaagcgaataggttcatttacaccgtaaccactggtgctgatatatgtagtagcatcttcccacatcatagtttctttgttccaaacaccgttctggtgagcttccataaagtcttgctcaccttggttgctgaaccagctacaaaatgattctactaaatgtggggcgcattcgataacaattttcgccatgttggctccaaacaaataatcttacgatcgtaagtaataaggcttgaagttttaatgcctttacaagggccagaaataaactctacttcaaaccacgggtgctcattcatcagacgaaggtctggcgctgtgcaggtaaataatgagcctttaaaaggcccatctaaaaatcggtgtagccgaggtgtcaaatacggtttgcctgagatattaatatgagccagcttaatcaatgtctcagcgttgcatttacccgtgtcaataaagaaacggagccattcagaagcatttttaaaacccatataattcatcattgtattcccatcacaaagaaaagaggatatttaccatcacgcacggtgaggcttacatgatcttcatatgccttataaaatttgtagatttcaggcattttagagcacggttcatctattataaccaatacacgtttaagcattagcccacgataagcatttccgcctgaatcagataagaagctacgcattgcattagaaaatagctggtttggaccgatttcaatattacgatggtaacatttgattttaatacggtctgccgttgatttggcataagagctattataagccaaacagattactgagccaccttcttcaatccaatctgaggcaaataaagaagccgcttcagttttacctgtttgtcgacctgcatcaagacgaagagtgcaatattcttgcatattagaaatacgtgaaggttcgtatttttggttacttaaaacatcatcagcatgggcacgaaatgcatgcatcagggtcaagtatggagctgttaaatatttcatttttatttctcggattagtggggccattccttggcacatagtagtccatcgataccgtatgtaaaccctttaccgcgttgcgctcgaccttattacaggtaggaaaaggtccatcactcagaggaacaatgttcatgaggagagggccggttcacctttattagaaagaacctctgcctttgatcgtattctgacgacctttattttctaattcagaatggtcaatttcatacgcttgggcgacaccaaaagcctttttaactttagctaaagagcctttagatgtgacaatattaaaagtattgcctttagtaaaatcaaccaaatccacttgtacgccttgtttgccaaggcttgctacaatagcatcgacatattgctggtccaaagtaccctgaacaccaatttggaatgccttaggtgctttagcttcagaaataaactcttgataagttttcatttttaatccttatgcaaacgggtcgtgaagtttattgccaactttacggaagactttagcagcaaatttgttagttgggttatcaaccataattttacgcatctggcttgtagctgcagtacgagctgctttataaccagcgatattatctttgatagttacacgtttgccaccaggaccatcaacggttactttgtatacgccttcatcttcacctggtttgatttcttcaatccagatatagccaccctggacacgttgggcctgggctgtttcagtgagaaactcttgataagttttcatttttaatccttaattaattagttgtagatagccttaccataatgtttataccactgaggccgttgagcaattttttcatccagacgtgcttgagaaattttaagagcatccagagtcggaacataatcattgcggaattcagccggaatgtcgctaatatcctgaacagtagtgtcctggattttaaaaccacgttttaagcattccgcgattaagtcgatttgacgtttacgcaagaactcgagtttgtcataaaagaatgttacatgaccagtacctaaaatgaaaactgaagagattttaaaatcctttagctttttaccattttgaacgtgcttacgaacagcaccaaatacacgaggtaattcacgatactcggccatcaggtgttggtcagctagttcagatactaaagttaagttaatgcgtgtcatttttaatctccgtttgtttggtatgagagtatcataacacggtcaaacggagttgtaaactacttcttagaataatctgccattagtgcagcaatatcaccaagtttcttaccaaacagatattcgacttcattacctttcttatcaacaatctgccattggcctgaacctttattaccaaaggtataatcgccaactttataagagaagccgcctacttttttaataggagtaaaagtgaatccacctttcttggccaaaaattccatccgacgcagatcatcggcatcttcattcaaagcctgttcggcaataaactcattataggttttcatatgctttccaagtaccagttttaaaagttgcaatcacgcgttttgctctgttaggagtctgattataccatcgggatttggctaaattaactgctgcatcgtcccaacgtttctctttaagcatacgcaaagaattagtgaaccctgcgacgccggcaacacccatctggaacaccatgttaattaacgcacaacgacgaacttcatctagcacatcataaacaggttttagagtagcattagccaagatacctttacgagctttttctacagaagaattgaaaagattttctgcttcctgttgggtgatacgaccattacaaacccgacccattaatcgatcaagttcatcacgtgctacattgtatgaagggtttttagtaatcaattgtccaatgccaatagtccaaaaaccttcagtgtctttgtataattctaatttacagccttcgtcaatacgaagcataccaaaaatgtccataggacctcctatctaattgatagaagtatttatcaacctacagacttgctttcttttgggaacatgcgttgcattacattgaacagacttgggcccatgacataattccattgagatggtttaatcaatgcaaatgcgtcaatttcggggaaccgttcacctgtttcacggtcttcatgatatgccgtacagacacaatccttgaactgctcgtggcggacagggagcggataaacaaacacatgcaaatctttattacttgcatatttctgacgtcctaggtccaccaggagtgctggattgtagtcaataaaaccagtttcttcacggcattcgcgtaccgcagcttcaagagctgattcgccttcttcaatatgacctttaggaatatcccaacgagaaggcatcccagaacgaaggcttgaattggtcacacgacccatgaatagttctttatcttcagtgaagaacataatccccgctgatacttcttttttaattacggccatttcggcatcctttaacgaatttatcaaattctttttgtttagcttctgttttctcacgttttctgatgaacggataatgaatcccataagctataataccggtaagaagagctaaagcaccaccaactagaacagagaaaattgtccatggtaaaatacaaactaacgaaataaaaatggcggcacctatagggaggcctttagccattaagattggccataataagaaatacaccatcggtaaatacccaagccaacctaacgaatacattcctacatcgacattacggtctactttatcataccaatattctttttcagcttcagttttcttttcaggataagacacattaggctgataccccatacaaaactcctcaattaaagctctttttaaaccagacggacagtgagaccaatctacattatgaattagaatacctcgatgacaatcatcgaggtttcgccaattgatgcaagctatcattaccagccttccatagggaattcaagataaacctgagcattcactctgatttcgttggtaatctttttgactcggtctgtgttacgggaaactcgaccgaaccagcgccaaccatttttaacagctttagaaccagtgtgccaggtagcgtggttgaattgaagtaatgtacggtctggagcttcccattgcttaaggttgccgtcttcgatgtgacgtaagacttctggatgccagtgcttgtaaatagttttgccttcaggaacttcagaaaacgtagcacgtcctgtcgcaaaatgagtaggacacacatcagcgttaacgagcccaataatatgttcagaaaggtaacgagggttatcataatcaggttgacctgcagttaagaaatgctgacctgccggaatatcaggacgtggaacgtcatcatggtggtaaccagggatagcagggtaccagccaggcatcagcatatggatacgagtatcaattacaacttggtcgttattccaatcatcaggcagattcatgatgaagctacgagtgataggaccaccattatcaaaagcgaaagctaaatcacagttgaagaacatcgtttcgttcttgattttgtcattagaaatacgaccagcaaaactacctacagcacgagcttgagaatcaaaagtttttggaccattcataatattttcctcattaaagaaggacatcttatcatgtcctcactctgttgtaaactacactaacttatgtccgccggttactttcttgatttcacctgcaaagcctaatgcaatttcacgttctctgttcttagcattctgcagattttctttagcatatttacgagtgttccaccactttttgataaagccgtttgtagctatttcacctgtacgggtgttcatgcggtttgttcgtacaagatggacatagcgtgaatatcgggtccaaaaatatatttgttggacaaaagctgtaatccaagtaaagaaccagacttgcatgcttccctggaaccaaggaccaaaaatagaaagtccccaatacgtgaatgttgccataataccagaacatgcaaaaccaattaagataatagcaaagaacttttccgttttccaagtccaatcagagttttctcgccataagtatagttgtttgataatcattttcagtccttcttaaatggcagaatcatgtgctggtttttcttgaagcgttcgatataatcatttacgccaagtgtcttatacatatggactactttatggtagttttcccaagcatattcacggaaccaaccactcgtaattgacgtacagaccttctctagggccatcatgaagctgtgctcggcagatacattctggaagttattaggaacctgagaacgttccaaggctaatacacaggtctcttcatagacacctgccagtttaatagcttcaggcaatgcttcgaacttttcacgactggtcattacttcggaaccgtctttcatatagaaagtatatgcaggacgatcagccagagctacggcacggtggatgctatcatggtccagagtatagatggtatcgttaaagaacgtatttttgcttacatccagtttaggatgattatagctcaacgtttctttctggcgaagaagcatgatttcttctagcttagcatcgagtttgatgcctttgttacgaaggaagcgaatatgctgcattgttttacggaagaacggattgttcttcttgaaacgatggctcatcttaatcgccagacacatttctggagtagcccaataaagctgagaaatattatcttttttcaaaaatgtttgagcatattcagctagcataatattagagccggatttatctgtccagtcgaaaagatatgcttcaaaatatgtttcgcggccattatgatgacatttaaaagcacgaacgttaggagtattaacttctacttcagcgcccatcatacgacatttgaaatcttgccacgcattagttgaggcaataaagtcccagtcagaatttttgatatcgtcatagccaatcaaaccatggtgttcaagagcacgagaaccgataactaataacataatattttcctcttaaggttatcccagtagggtcactataacatgaccctagttgtttgtaaactgctagatttcgtaacaatacgtattgtgggtttcgatgtaatcttcaagtgaagaacacactaatggatctgtagtaccacagatatcttcattataagggtcgatgccacaatgagcatcttcgaaacgaaccccatagtcagactttttgtagctgataccaaatatttgtttaaacttcttacgagagattttgtagcactctccgtcgccattaggatgatacatcataacatttacctcaacactgataagatgatgactgccaaccattgataatcatggagttgtcatcaacttgaatagcttcaccaaggtctaacccagaacgatcatcaaaataaatatggaccatttcgcgctcgtcggaggcaacttggaacaggttttcaagggcagctttagccgtacgtactgcacaatctaattcacgagacattttgatttcctctacacatttgaatgaaggactcgagatcaatctcatccttgtttacttctgtaaacggtacccataatactttaatagggttccaggccatatcaggccaagtgaatgggtctggttgttgacgatgatatacggctaccgcacgtctgatatattcagtaccataaattgaatgttctacatatggcaaagaaatgcatgtagtaccatcagcaccatcgatttcaaggtaaccatctattatacgaagtttcattttctactcctttctaaacaagtacgggcatcttatcactaagacacccgtttgtaaactgcttagcaccggctcatagaagaactataccagaagccttggtcgtgtggtagataatggtcttcacggacccatctgtagtcttcccattcatcagaagatgcaggaatgtattgttcgttgccggcccagaagtgctcacctgtggcttcagcaatttcttcgcctttagaaatcagggcagaaatacctttagcgatatcgtcaacggtgtttacgtcaaattcaaatttcatttttatttccttagcaagaagaaggttgccagatagagccatcggcttcaacgttaaattcacgaccaacttcttcaccgtagcaagaagagttgttccagtcgttaaagcgcatgctaccatcagaggtatcaaattcgaaaccgaaacaatcagcttcagccagttcacttactttgttaaacagaatagccagttctttagcagcttgttcgagttcaatgttaccagatacagacataatgtttccttagcattccatagaagatgatacccaaccacctgattcgaggctggtgtaatatgagtgttggttgacggtggcccaattcggattgccttgttcggtataatgctcaagttcctttttcaagaatccaggagaataatacgtcccacccataccataagcaggggcaatttcaaaactcaggtcgtatttgtcagcgactttctttgcttgattaatagcttcagaaatggccgcttcagcagcagccatagcaagttcaggtttatgtttagacattagcacatctcactcgaagaaatccagacaccttctgtaagattaccgttttcgtctagctcatagtccatagtacgacaagcatattcaatatagttatcttcggcattagtgcctttaggataataggtttcaccattaccataatcaccacggctcatagaaataccgtattggtccatcaattgttctgcacgagcttcatctacaggttccagaagagcttcaattgctttacgagcagaggcagcatcggtaatcagagggatacgagtttcaacaatttcaaaggcttggtttttcagtttcttactcattttcttctcacatttttaataaaaagttcagttgatttacgctcgttgattaaatcacgggcatctttttctgcattgtattctttattgtatttcttccatggaagatattctttaaagaaataaagcacgcgttcgctttgataagtccaataccaagttaatggaaacccacaaatcaaatattttgctgtttctactacccagggcgccatattatctttcatgcttttatcaaatataattatatctgcaagacaagtgacaagcataattgttgcagatactaagtcagcaattaaaaatgaaccaaaccaatctaagttacgacgaaatgtaggcttcattctatagtacatcataggctccttttctagctttaatattagcacggcattggtctacaaaatctaagacaataacagaacgatcttgattacgtcctttagtcttatggaaatattcgtcgattttagggaaccaatattccttcaaggatttaatcttatcactggtataagaaagcctaccaatggttgtatcacctgtagtaatgataacgccaaacttggttttgttgaattcaagggcaatatagtatgtgttatcactacgattattaaaagcagaaacagaccttttaagagactgccaattacgctcgtcattgttaaaggcaaaaattgaatattctaacgagtagatatcaataattttaagttgcccatgcccatctacttctttaaagaacttaatgatgttgttcatatcattaagaacaaatgctggggcgagacctgctttaaaatcagtagaaccaatagaagaccttgacggagcccagtcgctattagttatttttggactagggtactttgcagcaattttaataatatccattggtaaacgagtattaacagcaaaactcttaatcatatctcgttgattgggttttaaatgacgagttacagcaatcaattcatctgtgtaatcggcactattggcacctgatttaggcgaaatatcaggcccacaaccttcataaaaactcataatattttcctcaagatggttaatcttaattatcccggtaagagggccgaagccctcttcatattatttcagacttgccagatattcttcaacatcggcttcagtcgttacagtgccaggttcagcggtgtggaaggtatcaactttcatcagagtatcgtcgacggcaactttagccagtgcagcgatttcagttacatcttcagcagttgcaacaccaagagcagcggcactacgagtttcacggatgaattcgagcttaacagccaggtcctgacgagcatcatccagctcaactaccttctgttcgatttcttgacgcatacctacatattcgtcggctttcttaagcagagcttcagcagtacgacgatacagaagaccaagcttagcatgggtgtctacaggctggccatttgccaggagacgcttgatttctttttctttgctttcagccaaagtagttttatctgcagccagagcacggatgcgtttttcttcgttgatagatttcacatggctggtacgcagcatagtgattttatcaatcagaaggttagccgcttcggtgtactggtcttcgacagtagtgttacgagcaacgaaagaacccagtttagcacggatgaattcaaccagttttttcagaatagccattgtattttcctttcatgtgattaagaattaaattatatcccggtagtgtaggagcatactaacacaactcctacacgttgtaaactacttataagtttcgataatttcttccataaaatcaagtacaatattatcaatcacagagtgttcgtcttcgccatgagtttgcatagcagacagaataatattttccattgcacgtaaagccgacagacgttcttcacctgatgggaagttaggtatctggccaaacaggcgactaaaagaactgaaatatgcttgtgcagcagctttagctttatcaggatagtgcattatgttttcctctcatttgtctgtaggagcatcataacacgtcctacagactttgtaaacactctatttgtaccattcttctttcatagctttaagggcttcaatatctgcttctctatcataacgatattctttcatgcgacgtaagcccatgatgtcgctaccgaaattagaagaaatctcttcaagcacatggtcgaacgaatgatatagccgcccagatggtttgttgttagccctgaatttaacaaatttgtaaaatccagtatcagggtctttatagaagcaaaacgtacagaaacgtaaagcttcaaggcttacagccctaataagaaaatcctgttccgagaaagcaatacctttagaaggcttggcaaagaacagtaaagaaccagcaccaaaataaatcatgttttactcgcttagtttttctgacggcagattcgacgggcttcttcttcggccaggtcaatgatactacgcagaacaggagttttctggtaaagagaatcgacacggagaactacatacttagtgtccccatcatcatgccaaccccaagacttttcaccgtgagaacctttgattacggccgatacttctaccgaacaaccattattgccaatcttagtttcgacggtccagattccacgggcgatcgcggctgacttctgacgagcttcttctgcggcgatggcggcccaatccgttttctggaactttgccatgaacgtatcctggaattccagagcagctttttgctgttcaggggtcaaagattcaaaaatcttttgcatttcaggggttaattcaacttcctcgctgttttccatggacaaaggctcagacaattccatgagctcatctacagtcagacattcggtgtcatcagtgatagcaaaacgtttttgataccacggataatctaagcagttatgagactgggctgtcagcggactgatacgaatcagttgctgaccattatgcagaacaaagctttcacctactaccacatctttaaaaagtttcatattagtatcctttaccaaagaaataatcggtcagagccatttcaactgattcatcgagaaatacaagttcatcatcagcatcaagcatatctggtgtatcttcaagagcagcttcaccgtcacgaagaccttgaagtgctgcagcccaggcagcttcataatcaccgtcggcctgacgagcaatcagatttgcatgtgtcataatccaagaggcttgccagtgcatagttttgtcatcgaagattttgaacgatggacattcaaacatctcagcaggatattccgtcgaaatcagattacgtctcattttgtatctccagtttgtttgtgtaggagtatagtaacatggtcttttgtggatgtaaacacctagatgccaaaaagccctagaaaattttctagggcttaagattagatagtgtaagacaatccggtttgtttactcagttcggccaagtggaaacgtaacttggtcatcagaactttgatttcaccaacatgtttgtaatcactattagttgcttttctgccttgagatttgtaaaaatcttccaggttatcaagataagtttccatagctttgtacagagtagcattatcacgaagcataggaattacagcatcgattgctgtacgcagctcactggaaccaataacggtaccatatttaccattactgaaaaccttcattccaggaacttctttagcaggagctttctctggagccggagtagcagttttagtaactttaggtgtagcaacaggaattgcttctttagtcttaggcgctttaggagctttatcgacagcagcaccagtcagagatttgaaagcattctggactttgtaataatcttttggattgctagtaccgatgccataaagtttctgtactgaggctgcatacttcatgaaatctttacggtccgcatgaggcagaatatccattgcggactgccacttgagtttagtcatgcgctcgccggcttcagttaccagttcttcgctttcgagcaaaaattcattgaaatttaacatctttgttccttagaatatgaataggttgtttactatatttatcatattcgctggacgcaccgtccactcaggtaaaccacgaataccaagcgcacctcttgctcagataccccgaaagggtccctcggcaaagaaggaccctttcaagttcggctctgatgacttagatgcacccagaggtcattcgccagccttacgtctttgagtgcaattctaggacgtcattcttttaagttgatttgtcatagggctcgaacctacacgcttaggtctgttgcaccggcttccgccttactcacctgggtaccaaccagggtttcaaacaagctattccagtcgtgtctaccaaatttcaccacacaaatcataaattgtacggaacgccggggcatgcacccggttataaagcagttgacgctactctatatttttaagaggcgagcatctcgaccatatccgaacgtttcgtcaaaaacgctactcggcttacggcaaagatgggtcctcgaaccgtttatttggaggcgggtgatggactcgaaccatcgcatatcgggatatgaacccgaccttctaccaactgaatgtaacccgcatttgtccgggtccagagagtacaaacaagtagcttgatgtagaacacgctaaagatataatcttccgaatatagagcttatcccgtgggaacaaaccgcttcgtcctcggcattatcttacaggactcaaactcatctctctggactgcctcgtattgttgcgcccatcttgctgtggcattagaccatgaagcatcaccgaaatcgcctgattacgttaatgtctgggtgctatccagggaacagagcttggacggctttccatatcgtcatatggatttctattggggtgacctatgggacttgaacccatgactacaagaatcacaatcttgaattctaccaactgaattaaggccacatcaatgtccactcgtaaatgaacattaatttggctagggtatcaggactcgaacctgagcatcgtggaatcaaaatccactgccttaccaacttggctataccctatttaatttggctgacctacagagactcgaactctgataaacggattaacagtccgccgtaataaccgattatacgataggtcatcaaattggtgggtcgccgaagattcgaacttcgtacacccggattaaaagtccggtgctctaaccaagtgagctagcaaccctgaattggtggggagtgatggagtcgaaccacccgagtcgcaatgacaacagatttacagtctgcaccgctacctctacggaattaactccccgtgatacttttatttattcagtatatctcttgaactgtaaagcaaaatcttcatcgaccttagtcaagaagtgtcccgccttaaatcgtttagagctaccttcaacttctacaccgtaaccgttcttaccaaggactcgaccaactcgcatttcaccagggtcacccattgaattacaacgaacaccatatagaacaaaatcattttcgaataccggagtttgtttccgatctttaattaattctatcatattcaccttaaagcatattagcattacgttttaagttttcacgaactcgataaagatttgaacagaattcctgttcagtaaggacagtttcgttctttttagatttgcccatcgagtgagttaatgtagaattctgcgtagccagaagtgctctcttgaacccttcattacgacctaattgattatatgctcgttcgataagaagactgtaggcgtcactctggcgttgcataggtacgcctttccaatacagagtttgggtacgccaccaattctttttcttacctttaaacttagctgctttaccaactaaggtgcaaacatgttcttgcatctcgactgaactaaatttcagtgattgcaaaaatccttccatcgaagcacattctacaccatcaattgtaaaagcatgaggtgcaaagttacttaatgccgatgaaggataacctgagcctgaaccgatatccattaatcaccccattgcataatcatggcaatatcatcaatatctgttacgatattttcaatttcatcgataaaattagacagataaggaacaacattaggagtataaagccaattagcacattgaatgcactgattgcctactttatcctgaaagattacagcttcggaatggcttccacctttccattgtattaaggcaaatcctaatggatatttctgatgcattatattttcctcagtgtctggtgtcccctgatggattcgaaccatcgacccacagcttagaaggctgttgctctatccagctgagctaagaggacgaaatggtggccccatccggacttgaaccggaaacctaccagttatgagccgggcgctctaaccaattgagctatagggcctgaataatttggtgcaccgagtgggacttgaacccacaatccataaggcgggagattttaagtctcctgtgtataccaattccaccatcggtgcgttctatttcgaaagctctcttgatgcactagaagccgttaggtatattctaatgtctaacacgttgtcacgaataaacagaaaccctgcgcaaagtaaccgtcccaatcgtctagagaactttctgaatagaggcctcaatttttagagagggtataggattaattttaactatccttgaggccaaattggagtcataactccaggtagtaataataacactttattataaaagcatattaacgtaagtgtgttgaattcgttttaatttcaacttattttcaaagatatcatattcacgaacttgcttaccgtcttcagaaacaaagaaggaaaggttcacactattgaattcccagttgatatctttaagacggacatcagtagaactacgaccaatatcaacacgttctacttcatacaagtgctcagcaccattttgttcaatataacgttttgaagcttcttggtcaggcagataaccattttctggcttagtaatttgagcaaacaatttcattagcagttaccttctgcgacaataacatgagttttagcattaacaatctgccaccattggaagcgaccgctgccataacgagccttgtcttcgttggccgcaataatatcacgcagttcatcttcagtcgccgcttttgctataaggtcttcatatccaccacgtggatagtagttctcacccgcaaacaacaggaagttaggcacaatagccttaaactcttccagagtgattacagttccacctggctgcataatttcaacataactataagggcaattctgagctacgtctacagcctgcagaagtgtatcgtacgcaaagcctatttgattatctttatccttagaaggatttgccgaatagtcaccaaatactttatacatgtgccacctctacggtcatagtacgtttgcagacaacatagtcttcacggtttagcccttcaaagtcaagttctttcaaagcatcttcaacagcgccaaaacctaatgcttcagtcagaccagttagataccacccaccatattcaaaatcattattatacgcacagaaagaaccgaattctttgtgcttaattacataatcaaaagtttccatattttcctcacaggtcgtcacaagaaccactataaatggtcgtaaaagatgaatccattacttcataacggtcataacaaccagaagtaccattttctctggcatactctaaagcttgttctggtgagctaaaggtatcgataaggtctcgagacccaccaccaggataataacgagaccacataaacagtgcgtacatattttcctcactttgcgatgttgtgcatcaggaatgcaataccaccgacaactgcggttactgccagagaaaccatgttctcagtggtagtcagcagaccagtcaagaatccggcaaacatactgaaagagaaagcggttactgctactaaggcggctacattacggattgcttctgcacgtttcattttattctccaatcactcatttgttttgatagggctatagtatcatcactagagcccgttgtaaacatttattttagataaattgcgtattttttataaccagccgtctcgtggcgcagccctttttcattagcaaagcgttcaatattattaatttggttctggtcgagttctgaaatatcaaatacaaaaaagtttcgcttattgcctaaagttacatgattagtcaaatcaatactatagagataatttatattatcaatcatagtcttaacagatttgctaatttttacgtcttcattaagaatagattcagcgataaattcctgataagttttcatttttgtttccttaagttggtatgagagtatagtaacacgggtatttatggatgtaaacacttaaatgcaaaaaaggaacccgaaggttcctcatttaaggtcatcagcccaatcaagttttaatggttctttatattcacgatctagtacgaccggaatctgaacatcacccttatagctcacaggaccaacgttataacttaacgtgatatgtggggtgtagtcaggaaaatcatgtgttgcgcctaatgtacgtgcgtattgatgtctgcaacgtaggtactcagaatcaagaaccagtactaaaaccggtgtttcaccgtgattccacacttcaagatggcctgaagtagcaacttcaaaacttccacttgaaacggtataaggaatatttacacgagagtaacaaatagtagaatggagtttttcacgaggaaccggattaggaacacgtaaagagcgttggagttcttccaacgcgtctaaagttaattctgagaatttagcagcaacataaagtcctgtgctaaaatccttgaagttcattactcaacttctacttccagttcgccttgagcaggaaccagtgcttcaaccgctttgatgatatcagtaacctgaatttcttcaccttcaagaccaacaagtttggcaattgcaccaagagcttcaacgaatactttagattgagcctggattgcttctgcctggtcctggtaatcaaaaagacgtgctttcagtacgattagctggtcttgcagtttctgttctttagttaattctgacatttaaaacctcgttaaattttttgaatagttcatcagttgtgccatcattttcaataacaatgtcacggtcaataatagggagaccagcttcagtaatatgctgatcagatgaatcggctgtatcaggacgaaccacatgaataattgtggcacccatcgcccggagagcttcgatttcgtgtgtttgtcttacatcaggaacaacgaaataatcgaaatctgaataaaatttatcataatacttttcagcaaataatttcatccagaacatgcggtcaataccatctacgacaatgtcagttccaagggtctgcatgaaacgtcgaatagtccatggtacattgttatttattgtaagattttcaatcaagctaccaatcgtattaccgccatcaaatttaaaataatccagacgatgacgtcttgaaagccaatcaagagattcttggaaaaggtctttagcttcgtaattgttcattacaaatggacgttcacggtcccactcgccaataccttcccagtcttcccattgaagttttgggtgagcactttcatgattgaaccgacgtttccaagcctgagacaaagtctctttaataggctctgcaagttgatatttgaacccattacattcatttactacatattcggccagcgtatctttaccagaccgctttttgccgacaatagcaattaatttcattttcacctcatagaaggatgcatagccattttacgtccttcgagtctgccttgtccggcatcatcaatttgtggacgacctagtactatattaccatctatttctactgcaaaactcttaaagttaaatgtagccatgcaaggcacagcagggtcagaatcttcgcgatagttgaactcaatttcagaaaggtctgaaggccaagcaccataataatgaatggacatcacaatattctgttttgagttatcaaggatatgaacagtcaccgcagaaggctgtccagaagcgtgccaggcttcgctctcgtgtgtcatatagttgtttaatgataacatccatttatagatttcgagccaacctgagagctccctgtccaccaggaagttaaccataagagggtcgaattcgatagtgcttccaggaagtttagctcgagaaatgccttgtgttccacccggtaaatcgcctactgggatatgaatcccaggtaaagttgctgcttggcagttcaacttaaatgattcggtgaggccattatcagagacctcaaggataaagttagttacgttagtctggttaaacagaccaccattttggccattcatattcacaccttatacgcttaattcccggacagtgtataatggtcttaggtctgttccattcaataactggccgggataatagattattatttactgttagcccatactttctgagcagagaaacgcttacctttagacatgaattgttgtaacggcatcatgacaacattagcccaatcggctggttttatttcaactaaaggtcctttaatatttccagggatataagctttaatcatctggtcagcaccttggaatcctttcactttagtccaatcaattttcagtttagtagaattcgtgatagtaggcgtgctcgcatattgcttcagcaattcttctaaaaactgttgtctagctttaggcggaatatagtgtaagttcaagccgtacatcaaattatgcttacctaacccaagatatatcacaagtggatatttgtcccagtatggtaatgtgtctttatgtttggcatcatagatgtaagcataaatcttgccaggttgtggcttagaaacctgatgtcctctgatacctttctttaatgtctctgtaaaccaacgagctgatttgttgtttacggcagcaccttcgttagcaattttatctcttatgcttttacgaaagctattaatcattataagctgacgttcggctttggtcaatttattgccaggtttcttttcaagcttttggacttggtgcgccagcttgatacgcgaagcgtatcttgacattgctttagtgaacgtagcgtaattcaatccacgttcatcagcgaaagctttaccagattggcctttagcctttgcgttataccaatcaacaccgatcgctacccactgttgttcatttttagtaggtttagctgttcgttctgttgattcgttgatgaaagaaataatgctcatcctttccatcctaatttcttgagtgaattctcagtaatcaatctaaaattgatacccatcttatttgctgtagcctgagctgcggtccacttatctttattcacacaccatgtgtagtattcattcatgaatcgctttttagaagctgcagtcatattagcaggttgttttggtggctgggtttctttagaaggttttacttcaaagaaaaattgtttaccatcatcaaacttagcccagaaatccataaagtaacgacgttttttgccatcagcattgctaaaataagggataacaacttcttcactgttccattgtacaacatttggatggttgtcaagccatctcatgaagtattgctcccatgacgaccgataggttattttcttccaatcgcctttatatttctgtttgttagttggaataaattttcccgagtaggccatagggacctccatataaatattgatatacttatttataaatggaggctttatgctgttttcatttttcgatcctataaattatgaagccaaaactattaagaaaaatgcggcctcattaaccaattcggatgtccaatctgctcctatggcagacatcttccgcgactatatgacatatttcaaaaaagttgcagctaactataaactcaagacttattatattagtggtgctcctagaccagaagaacttgcatatcaaatttatggcaacactcagttatactgggttcttttgatgtgtaataccacttacgacccattctggggttggattacaggtcaagaggctgcatatcaagcatctattcaaaggtacaaagacgtaggtggaaataaagttctttatcatgtaaacgaaaatggcgagaagttctggaacttagttagttatcctgatgcgccacagacttggtatgataaaggcgatagaaatagaatgtacccacaataccaagggcctcttgcagccgtagatacttatgaagatgctattcttaaaaatgaagctaagcgtgaaataaagattattgacccttacgatatcgaatcttttatttctaatcttatccgcgaaatggaaaaagccgtatgattaatatcagtgattcagtttcatggttcgtcggtgttgttgaagaccgaatggaccctttagaacaaggtcgtgtacgcgtgcgtgtgtggggtcttcacccttatgagaaaactcaaggtcctgtaaaagggattaaaactgaagaccttccatggatgtctgtactccagccaacatcatcagcatctgtttccggtgttcagcaggctattactggaatggttccgggtactcatgtgtatggtcatttcttagacaaatggaagcttaatgggcttgtattaggaacgtattcttctaattcaatggtcaaggctaatcctaatgaaggttttgctgacccaacaggacaatatccgctttatcttggtaatgatacgaacccattaaaccggggtggtattcctggcgatgattctacggttaatattattcaggatgctaaccttgatgttggtattaacccagatggaaaacctttatctgaaataccagaagataacaatcctaattatactattcaagcgatggttcaacatgatgaaggtcttcgtttaaaagtttaccgtgatttaaacgggcgcgggtggacagtagggttcggtcactatattagtgataacccaaatttaactaacgaccaaataaattccgaattatctaaacaggttgggagagaagtaactggaaatccaggctccatttcaatggatgaagcttcaaaattatttaaagaagatttagaaaaagttcaaagagacatgagaaataatgcagctgtttctccggtctatatgaaagtgaacagatctcgtcaaatggctttagagaatatggcattccaattaggtataggtggattagctaaatttacaaatatgcttgaggccatgtttatcggtgattggaccactgcatataaagaagccagaaactccctttggtttaatcagactaaaggtcgagcttctcgtgtatctatgattattcttacaggcaatatggaatcatatggtattccagttaaccctaatcagaatccaaatggaaggatggttagttttgcaacattagctgctgagccagtggcaagtgaccccgctgatccgtgggtcccggaagatactagaatattgtttaaagaacctccttcaagctataaagggcaatatccttatgttcagactatggctactgaaggcgggcatattcaagaatttgacaatacgccaggtcaagaacgttatcgtttaattcatcctaccggaagttatgatgaaaccgctcctgatggtcgtcgtaccattaaatcagtagccgatgcttattatatgactcaggccgattgttctacgatgattggtggtgataataaagtcaacgttggtgggaatgaagttaaatataatatggccgatgttaggcgtcaaactgatggtaatgaaactattttcatccgcggtaatgacactaaaacagtagaaggtgatgggactcttcacgttaaaggcaatattaaaattattgttgaaggcgatgctgatattgaagtccaaggtaatgcgaaatctcatgttgttggaaaccatgagtacaccgtcgatggtaacctaacttggaagattgccgggactgtaaatattgatgtaggtggttcttggaccgagaagttcgcttctatgaattccgttgcatctggtcaatacactattgatggtagcaggattgatattggctaatggctgaaatacttcctatgagcacagacctttccgaagatatggaagggtcttctatcgacgtcacgttcactgctcaatttttagaaggcgagacgttagagtcaataaatataatagattatgaagccacaccaggcattaatgctgaaggcaatcgattatttggtacttatagagatgtttttgcacttggtggtgatgctttaaaatatagaacaattcaaggtcaacttctttctgctgattcttgggactcacttcctggttcactagatgctcaactttattactttaaagcccctaaggcgctcactaagacatttaattatgttgtagagttaatctattggtaccaagctccgagtacaggagggagcgcccctgacgaccctgtcgttactcctccagcagagaaacgaactatcagaaaaacttatttcaaaactatcgtaggtaattggtctaggtgggcaaatcaattacgttcgtatgtttatgcgaggccataatgccagctttaagttttaataattgtatgacaacaggccaccaagcgtggccacctacagaagttttagcatctcaaggcaaggtatttactggtggtatagcggttgttatagccggagataaaatagtacctcatactgaaattaaaaagccttatgagacacacggtggttctgttgaaccaaggacaagtaaagtctttgttaccggtaagaaagcagccgcaatggcagaccctatttcttgtggtgacaccatcgcacagggttcaccaaaagtattcattcactaggaaaatataatggcagaccaacctactaattttcagttaactagacaagttaacgcaatcccaaaagtatttgtgggagcaacatttgaagaaattaaaaagaacataattgattggctgtcgggtcaagatgaatttaaggattacgattttgctggttccagaatgaacgtccttattgatatgctagcgtataatactctttatatgcagcaattctctaatacggcaatttacgaatcatttatcggaactgcaaaccaacgttcttctgttgttcaggctgcacaggataaaggatatcttccttcttctaaatctgcagcaaaaacaagtcttcttttaactgtcgagaatgctcgtcctgattacagtattaaaatacctcgtgggactaaattccttgcttatgcacgggaatcacgagttgacccatatccgttcgtagtaactgaagatgttatcgcaatcagagataatgctggtcaatatcgacctattattaatctagcccaaggccgaattattcgtacagaacttttgtttgacccaactcagcctattattattcaagaccctgacattgaccgtaaagaagtcaaattgaaagtaaatggagcagaatggactgattggactaacaaatcaatggttcatgcgggttctacttctacaattttctatatgcgtgaaaccgttgatggttttactgaattcttcttcggtgaaggtgaaagttctccatcggtagctggcggtgtaatggaagctaactatatcggtgggttaaaaccaactaaagaatcttcaatcgttattgaatatcttcgtacagatggtgaagccgctaatggtgcaacagatttcagttacgctgatacgttaactaacctgacaattgttgctattaccgaaaactatgataatagccctgactatgtcggtgcagatggtggtggtgacccagaagacattgaacgtattcgtgaacttgctgttgttaaacgtgaagcacagatgcgttgtgtgaccggtacagactatgacacgtttatttcagaacgattcggttctattgttcaggccgtccagacatttacagacccaggtaaaccaggctatgcatttattgcggttaaacctaaatcagggttgtatttgacggcagttcagcgtgaagatatgcaaaattacttgaacggatttaatgtttcaactattacaccaagtgtaattagtcctaactatatgttcttgaaacataatattcgtgtaacttatgctcttaataagctccaagaatctgaacagtggttgaaagcccaggtcattgaccaaattgatagatattacatagacgaagttgaaatctttaaccgtggatttgcaaagtctaaaatgcttacttatgtagataacgcagaccatagtattttaggttcttctgcgacagttagcatggttcgtgaagtattaaacttctttaaaacaccagcagctggtattaaatactacaatcaatatacaaaccgttctgtagaatcatccgtcttcaaattcattcctaccacaggaacaaaatacgatgttagaatcgtagcaacggatagaaatgctacaacaggtaaaggtaaaatggttattggtccgttccgtaatggagatgttacagttggaactctttatactggaagcgatttcaataaaatgtctgctcctgcaaaccaaacacgctattatgtgattggcgatatcgattactatagtgatttcatttattgggacatagccgctataggtttaacttctaataaatttgaagtccagtctatcgagctttatgcaggaccttcgcaagataatatctttactaaagacggttcattaattgtgtttgagaatgaccttcgtcctcagtacactacaataacaatggagccaattgcacaatgactgtaaaagcacctgacgtaactagtttacgaattgacaaactttctgccaatcaggtcagcattcgttgggataacgtcggtgcaaacttctattatttcgtagaagcatgccaaactcgcgataatggggtccctttggaccccgctagatatcgttggagaaacttaggttataccgcagagaatgactggtttgaagatacattcgtatcgccgaatcgctactataaaatgagggtggccgtagctgctaaagggtttgaacaatctaattgggttgaaactgaagaattccaaatgttttctcaaaacgcttatacttttgagacaatgagagaattcacactaagtacaaaatttattaacgaaaaatttgttttcaatcgtccttatattgatttcaaccgtgattctatagttgcgtctttaatggcagagaattttcaatattcgcctgcatttaatgatgttagttccattaaaaactttatcctaaattcagaccagttccatgaaatacaaggtcctatcgaaaaggtgtgtattgatgtagaacgaactatgctggctgaaatcggcgacgttctttacttattcgagcgcttccagccattggtaaaagtttctaacgataaaggacagaactggcaatacgtaaaattattcacagaccgtgttggtaaccctgtttcaagaattccttattaccagtctaatacaacaacttatgttttaggttatgaccgtgtgttttatgggcgtcaatctaacgatataagatggtcttctgatattgttaaatttagttctcaggatgtgacatttgccaaaataggcgaccagcttaaattaggctttgatgtagaaatctttggtgactatgcaagactgccgctggccatctctaagatagcagaggcgattactgtttctgatgactatatctatgtggtcgggcgagataaagtctttaaggctaaaactactaacgctcctgttgatacagaccctaactcacctacatttggtgagaaaatgtttgaaaccggcttttctaatatcaccggtaaccctaaagctgtatgctttaaaatggattctgttgatggtagagtactggcgctaatcacaggcgaagttaaaactctaggaatggaccctactgtccctgctaatgttatcgattctgaatctaaaggcgtttattggcttgacgttgaaactgatacgtggactcgtgtatttggtaataccgaagaagaacgccgtcgaattgagcacggccggtcgtcattaggtacagatggtaaagaaatattcttctctagtagcaactttaaatttgaagtagaagctgattctgaaatttctgcaaaatatcctgagttggttaattctggtgttagttatgtatatgcagatgaaaaaattcatgataagcattacttaatgatgagctttagaacatcagcagattcagatttcaaaaactttaaaccgggtcgaatgacttattatgccgagcctttctttggttggtgcagaagagattctgttcgttcttggataactaacagcaatagagcaatggttgtttattcagaccagctttatcaaaagactatcgacctgtatggttcaggttctccggacaggattgttcatgaatactgggaaaaaggccacgtaaccgtaacagcacctaatatcgaattcaaagggttcaaaaaatatgcatcaggtattcttcttcataaaaatactggtgaaataattggctacttcgaatttgactatcgtgttagagacgaagccttgattttctggaagccaactgaaataatgtttacggccgacctgcaaaaccaagaacgtgaaataccgtggactcctaaagtaactaattctgaacgagacccagacctcagaccacttcttactaaaatggttcctgacagctatttgcttcaagatactaattttgagaagttctgtgagtattatctccagtttatatcagatggttcaggtacccagtataacaacctattgaatcttattcgtaacaaatatccaagagaagaggatgcttgggaatatctgtggtctgagatttacaaacgaaatatttacttgtcaaaagataaacgtgatgaagtggttcgtttctttgaagcacgtcaatctgatttatggatgacaaaaggtacagaagcttcttataagttcttgtttaaacttctttataacgaagacgttgaaatcgacattgagtcaaaaaatactaccgaatacgatattatcgtagagtctgataacatcaatgaagatgtcgtaggaacaagcatttacactcctaccggacgtagtaatgtaacttatatcgagcgtgaatataaagatggtaagcttagatggcgtatcactattcacaaccttttaggtagatacttagttggtcaagaaatcaaatcagacataactggattcaaaggaatgattatccaaggtgttcgtggtaaagatttaatgactaacagcattgattatatcgaccgtaacagaagttattatgttatgacgattaaatctaatctgcctacttctagatatcgtaatgacgtcttgagatttgttcatccggtaggatttggcttcattggtattacgctcttaacaatgtttgttaatactggtttgacattaaaacatgttgaaactatattaaataaacttaaaaactatcgttggtccgatggaattccatcagaatggtatgacagaattgcatctttaaatagtgccggtgaagttaaccgtgaccctgttacaggcgaagttatttacttgattgctcctaatgcaggtttgccattcccattaccttcagactatgactcagaaaatgataactctattttccaaggtcagactccttctgaaaggcgcaaaaaactaagtgctctgttagaccaaagcggaataacattctgtcaatggcgtgaacttgttgataaacgtcttaaagatgatataggtaatcctagagacccacgtaatccaacacaggtaaaagtagatgaataatagttctgtagtctatcgttcgattgttacttcaaaatttcgaactgaaaagatgttgaacttctatcaatctattggtgatggtgcaaaccaaaatacgatgtatgttactttcggacgctcagaaccttgggcgtcaaacgaaaatgacccaggttttgctcctccttatccagtagatgatgttgaaggaattgaagatatgtggacccatatgatgggttctgttaaagtttacaagtcgatgcttgatgctattactccacgtaaagattggggcgatatcagatatccaaacccacgtaacttccaagtcggtgaaatagtagtttctaacagcgctccatataaccgaacagatgcaggttcaggttggatggtttatcgttgtgttgacatcccagacaccggcacatgctcaatttatgaactcactaataaagaagagtgtatgaaattaggtggtaaatggacatctagtatagattctatgataccaccatctgggactcgtgatacagaaggtggtgaaataattaatttgggcgatgggtatctttgggaatatctttatgaaattccacctgatgtaagtattaaccgttgtactaatgaatatatcgtagttccttggcctgatgaagttaaggcggacccagaacgttggggctatcaaaataacttgtcgtggcaaactggtgattatggtgttgtgtttagagttaaggcaaacactataagatttaaagccttcttagattcggtttatttccctaaattcagtttacctggtaacaatggttttagacagatttctattataagtaatcctttagaaaaacgtgttattccaagtgaccctaatgtcaaagctatcaaagagtattatgatgcggttgatttagatcgccattcaggtgaaatgatatacatggaaaatagacctcctgtaataagagctatggaccagacagaagaaattaacatcatcttcgaattctaataagggccttcgggccctttcggggctataaatattgatatacaataaagaggctaaattatgattccacaagtaaatggcaaacttttaatcgacgttggagagattggtaacacctctaccggcgatattctctacgacggtggtgttaaactcaacaccgatttaaacaacatctataatacattcggtgaccaacgtctagccgatgtatatgactcacagaaattacacgcaaccggatattatcaaaaggtcactaagacttctgatttcgggcctggtgtagaccctggcactcaggccgacgtagatacttcagccggcaatataatttgtgctgttcgaaatggtaaagtaggcgaaggcgtagtctttatcaatagtactggtagttttagcacagaaaacttttttgagattcaagtagtagatagttttgtttctattccttctgggaaccttcgtgtgacaactccttttagtagaattactgtttggtgtgttagtgtagaaggtggtgtagttaaatgggattatagcatcgaaagtatgttcggtgataagtcaattcctttaaacaaaacgttccaactttctaatgttaaacgtgatattcaacttttccctaaaggacaatatcaaacagctaaaatattagcaaccgcttctactacggatggaactaaatataaagtatctgaaatccttttatacgttgatagcgttgctaataaagtatattcgactgaatatgcagttataagaggtggggccgcaaacgacgaagatgaattatatgatttgacgtttagctctcctgtaggcgattatataattgctacagtaaatagctcgagcccaacaatgcgcttggctcttaaaatagtagaaacgcaatcatttggggttactatctaatgaaacaaaatcttaatgtaggtaacgttgtagatgacggtaccggcgactacctgagaaaaggtggtcttaagcttaataataactttgatgagttatattatcaattaggcgatggctcattcccacacgccgccggcgcatggaaaacatattctgctacacaaggtgctgtattagcggctagctttggtaagtcgtatgctttgaatactactagtggacgtattaccgtaaatcttcctaaaggtaatattgacaaatataactatgttattcgtctgagagatgtattcggtacatggcagcgcaacccggttcgagtagttcctgctgctggtgacaccattaaaggctctcctaacgcagtagaaattaacagaaactttgccgacctggaattagtttattgctcacctggtcgttgggaatatatcaagaacaaatcaatcgaccgcattgataacaatgatatcgctacagtagcaactcaagaatttattgccacacaaggacaaagggatttcatgaacatcttttctgctcatgattacaaccctacgaacttgaaagttttccatcgtggtaacttattgttctacggtaaagataatgtttttgatcctgttaacgctgaagtaggttctcctgttcctggtaattcgactgcactacaggcatatgatggcaaaaatataagacttcgtaacgcatgtaatgaaggcgatactgttatcgttgtgtcttatatggatggtttgggtcaatggcgatcttcatataaccgtagacaagtccgtgttcttgattctaagtatacaaataaaactactataaatggtagtgttattgttgacgatttagaaaataaaaaagttttcaccatggctgaactgggtgttactccggaccaacctgtgaaccctaatgcggttgaattgtctataaactctgttcttcaataccaggcaggtacagctggtttgcctgtattccgttgtgaaggcgccgatactgaagacgcagatgactgttatgatttaggtggtcaatgggttgaatcagccactgattttctttttgatactggttcagatggtattattgttgaagaagttagatttgataaacctttagaacatggcgatatcattactttagtatggtataacaataatattggtaccactctagaacttgaagaaattttgttagagactgattcaagatatgtttctggtatggacacggttaacatcacaggtgatgttcgtattactgatgttaataatccattctggcctaacgtggaacctgtttctcctacagaataccagccaaatacggtaccagccatttttgatttagtatatccggttggaactatttacgaaaatactgtgaaccctaataacccttctacttatatgggctttggtctttggaaaagattggaaggaactgttttagtaggttggtcttcatctcctggtactaggtttaacctgaataataaccacttagatactacaggaaaacagcaaagcactgcaggtggcacaggtggcaatgatgatttgactcttaaagcaggtcaaattcctatgcttagaactgacgacaaagtccttgtcgttgaccctaacggtcctattgtggtcggcggatgtcaatttgacccggatgcatcaggtcctgcttatacaaaatatcgtgaagctcaagctacaatcaataaagaaaatattattgaccctgctagtattgatatcatgaacccatatataaccgtttatcgttggatgagggttgcttaatgtttagtttatcacgttctaaggcgggagtaatatctcgccttgccgattatcttcaatttcggctaaatcctaataaaacagattttgtagcaggacaaagggccgtaggtggtccttcagcctctcaaacacaattaggtattttttatcctactgtccagggcgcaattgatgatttggtaggtcgttgtgatttacctgtaaatactgtagtaattaacacagacggacttccacctggctttactaatcaaacagaccagcttaaatttagtggtgttgttcaaggcgcgcctggctcagaacaaatgatttatgttttaggcttcccggttaaagtcgctgaaggtgataccgatatagcggtagctgctaaagcacatgctgtcttaaccgatgctgttgttaattctattgcgatttcatctgtagaaatagatagtactgactctactgtattaaatattacatataatgattatcagacacatatttaccagccagtgcctcaatatggtatttcgataacccaaactattgtggtagaaggtaaagccgggtatggtaactgggctagaatgggtactgtggaccaaactttgacaggcggcgaagtcgatggtaatattactttgtactattttagaagagaatcataatgactactaatacaatacgtcacgtcagtgacgaatcggtatacaaaatttttaaacctgcaggaaccgcatttccttctaatatcacaaacgttcaggctgccttagcagccttgaaccctattgcgattaatggtatccctaatgcaacacaaaccgttatagggataagtcgatttgcgtctcaggcggaggtagatagcggtacgcttaacaatgttagtgtttctccagcaacattaaagtccgccatcctgcgtccacctgcaacgactacggtagcaggtcttactagatatgctactacttccgaagctttagcaggaacagtaggtaatgctgcggtggttcctacagggcttaaggcttctgttgatgcagcaaaaacacaaattctttctactcaagccaccgaactagttatgggtctggctaaaatctctacacaggctgctgctttagcaggtgcagatgatttaactataatgactcctaaaaaagttgcgttagctattggtaaagctattgcaaccgttccatcatattctaacgcgtccgaatcaaattatggtttagttagaatggctactgccggtgaagttcaggcaggcaacgttggtaatgcagttgcaatatccccagcaaatttaaaaactttaatttctactacttcgagaaatggtttaatttctattgcttctggtgctgaagtcgcagcaggctctaataataccaaagctattactccggctgcattattatctagaacaggtaatgaaagtagaaccggacttcttaaaacaactcgaactgttggttcaggtgatggaagtactgcgttagcgtataatgctaatgttatttcaacccaaggcaaccaatctattaatggtggattgactcttacaggtcttcagattaatggacaggctagtataacatcaaatacgacaattggtggtaatttaaccgtatcaggcgggattacttctagaggacaacaagttgttactattgatatgataggcgacgacgtccctgtaggtgttattgttatgtggatcggtgctgcaaataaggtcccagcaaaatggcgtatttgtgatggtggatatacttattcagcgtcttcaaacccggcgctttggaatgttttacctaccggccgtgttcctgatatgagaggtttatttgttcgtggtgctggtgttggcgctgatattcttaacgctcaatcacctgatagtaaaggtaagccaggtcttggcgtaggttgtggtgctggcgctgtcggtacagttcaggctcaggctgttaagaaacataaacacaacagtggttggggtgaacaccataaccgttctgatgcatatttcggtgctactaaccgtaatggcttccgcggtaataatagacgtgatactgacaactatctgtattttactaatgatggtaccgaatatgaggccgaaagttctagagattcattcggaacaatgaaccctaaagaccttatgcaagacgaaaatcgtccttggaacatcgcagtatattatatcatcaaaatccaataaggaattaaaatgatcgaacatttggaattaaaaaatcttccatatgtcgatggctatcctgaagcagaccagaagcgcatcccatgggtgcgcaatggcgaatgtttagacggtgctacgacaaaatatggtaatgatggcacattgaatggggcgccgttaggaattcagcgaaacgttgaaaggcttgaagaaaacaccgaacttactaaagatgctttaaatgtagttattgacaatgttaataacattaatgaagcattagaagcgggttctgatgtaagtatcatccaacaggtttctaaaaacaaagaaaacatagaaattcttcaagttcatatgcaatttgctgaagataatattggagacctttatacagacactgaattccttaaagaagatttaggtgtttatgaccccgcgaccgatgggtattatcgtcctgttcgtgatgatattgtattcctgaaaaaagaaattggtcaatatccagaccaagatataaatggacaatctaaaccaggcgcagaagcaactggtatgaagcgtcgcattattaacaatagctcggctatcgtttctcatgctgttagaattaaaactttagaggataattacactgattctgatgtaggttcattaagtattaaaattaatgaattgcgtactgaattaggccctagagcaagttctatcggtaagcctgacgtttatactcgccttgattctttagattctgccaccgacgtttctaaagaaactatcgacgaaattaaagaagctattggtttaggcaatggtgcgtctattaatactaggatgaattctgctgaatccaaactaagtgatattgatgttaaccttaatactcctattacaggattaaaccctaaagttactagtattgaaaaggctattggtacttcttcagaagcatctactataaatggcagattgtatagattaagagaagaccataatgctttagctgctattgtcgggaatgattcaagctctggtctgcgaggtcaagttgcatggatgtctgaaactattggttcttctgttaatccgactcctacaagtattcaaggacggttaacttcagtaaccactatggcctctgcttctgcttctgatatccaagatatccaagttgaaattggtacaaaccaaactggtttaaagggctccgttctgacgttaacacgacaaatgaatggtacaaaccctaatggtaatactgttgaagagcgtggcgtagttaacagtgtcaaaattttagaaacccgtacagcaaatgttatttctgatgctcctgcagacggtttaatgtatgcccgtaaagattctctttgggttgtggttcctagtgcggatgacgttactgatatccaagatggattagctgcagccaatttagaaatttcttctcttaaagctagaatgaatgaagctgaaacagaaaccgctaaaatagagcctctttctgttttagtgagtacaaattctgcagatgtatcagacgctaagtccaaaatagagcttttagaagctgaattagaaaatagaatagaaccatgcccacaagatggccaagcttatgttcgtgtgaacaatgattgggttcttctttcaacgttcttaacaccataataaagggcttcggcccttttttggcataaatacttatatctaatatgaggacatcttatggctacagaatcttataaccctaaacaactcaaggattcaatccttcgtcgtttaggagccccaattattaatattgaagttactactgatcaagtgtatgattcaatccagcgcgccctggagctttatggcgaataccattatgacggctttaataaaaactatttcgccttccatattggtgaagaacaactcgcacgtgatttagtatttgacctttcagggcgtggtgtgtttgctgtgacccagattgttcgaactaacgttggttctttaacatcgatggatggtcaggctacttatccgtggttcaccgactttgttcttggtttagctggtattaatggtggtatgggctcgagctgtaatacattcggtcctaatgctttcggcgcagacctttcttattttacccagcttatgcaatatcgttctatgatgcaggatattatggttccacttcctgattattggtataacgatgataccgagatgcttaaagtaatgggcaaccttcgtaaaggtgacctattaattgttgaagtttatactcaaagttttattagcgtagacggaatggcagtaggtcaagctggtatcggatatgctcaatcttgttctacggacccttggtctttacaagataaatatgaggctccttggagaacaaccggcccagctcgtgctggagaatctactgctcctagacaaggcgcatataataaccgttgggttaaagattatgctactgcattaacaaaagaagtttggggtaacgttctcgctaaacaccaaggaatgcagatgccgggtggtgtaactgtagacggtatgcgtttaattgaagaggctcgtcttgaaaaagaacgtctccgtgaagaactagatttactcgacccacctttcggtattttggtaggataatatggcaactttcgattcaagtttatttgcaaagctcgagaataacacgggctatgataacacgaacgaaactgaaatattaaacccgtatgtaaactggaatcactattctaatgtccaaacgttagctgattctattgtggctgaatctgttcagatgcgtggtattgaactttattatatcccacgtcaatatgtcaaaccagatattatctttggtgaagacccacggtctaagtttgataaagcctggaaatttgcaggatatttgaatagctttgacggttacagcggtgacaatacttattacagtaagttcggtatgatggttaatgatgaggttgaaatcactattaacccaaatctctttaaacaccaagtgaacaataaagaaccacaatccggtgatttaatttatttccctatggacaacagtctatttgaaataaattgggtgcaaccttatgacccgttctatcaggtcggccagaacgcaatgcgtaaacttacggcaactaaattcgtttactctggcgaggaaattaaaccatcactccaaagaaatgaggggattaatattcctgaatttagtgaacttgatttaatgccggttcataatattgatggattagctgataccaatatcgagcaatatgcagagtctaatgcatttaatgaagaagccgctgaattcgtcgaaccttatgtagttattaacggtaaaggtgatatggctcctcctaagagctctccgtttgatgatgattttatgtcataaataaagcatataataccccggctccggccgggaataactcactggaggtgaactttgtttggtcattggtacaattcatctcttcgtcgttacattgttctaatgggtgaccttttttcccacgttcaaatacaacgtatgcgcgaagatactgggatgaaatatattaaggtccctattacttatgcatctaaagaacattttatgatgcagcttggcaaaataaacgccattcaaaatattccttcgcctgatatgtctcctgaagaaagagctgctcagattgcgaagattgaaactattcttcctcgtatgaaccttcatttggttgatatgatgtacaacgcacagtataaaacagcccttcaaaacaggtcgatggcacaatatagggataatgaccctagaaaagcaataagtcaattcagtcctgttcctatgaaaatgatttttgaattaggcctttatactagaaaccaagatgatatgtttcaaatcatcgaacagattatgccgtatttccagccacattttaatacgacaataactgaactttatactaacgaaatcaaatttgaacgtgatatcagaattgtattccaatcgttagcaatggacgaagtaattgaaggtgatgccgcatctaagcgtcgtcttgaatggtctatcatgtttgaagtaaatggctggctttatcctcctgtttctaatttagaaggtgagattaaaacagtttatctggacttctttgctaatagcaaagaattaaaaccagaaggtaattttgaatcagtggactctgaagttgttcctcgtgatgtagaacaaagcgagtgggacggcgaattaatacagacctatgattcatcaggtaaacctattccggtcgcccctgagccaccaggaccacgaggtacataatgagcgaacttaatattgcaagtctaatggacatcagtgaattgcctggaattgaaggcgaagaaatcgaggtctatgctccattagaactggtcgaggtaaaatccaaccctaatgaccgtaaaccagacctcgaagatgactattcagtggttcgtaagaatatgcacttccaacagcagatgttgatggatgccgctaaaatattccttgaaacggctaagaatgctgattctcctcgccatatggaagtattcgcaaccctgatgggtcagatgaccactacaaacaaagaaattctgaagcttcataaagaaatgaaagatatcaccgacgaaaaggttgatactaaaggacaaggtggtcaacagactactaatattgaaaatgcgactattttcatgggcagccctacagatcttatggatgagattggtgattcatacgaagcccaagaaagattagaaaagcaggttaattaatggaattaccagtcaacgtactgagtgatgaccatccattgaatgtgggcgatatgattgtcattcgccctccttctcaactagaaacaaaagttgaagatgggataacatggatgaaatcgcaatgggatgggaaatggtaccccacgaaatttgatgattatcttagaataaacggtattgtaaaaattcgtttgcagggtgaagaccctaatttattccagacgttcaaagataaaaataataaacgttctcgttatatgggtttacctaacttaaaacgagctaacattaaaacggcttggaccagagaaatggttcaggaatggaagaagtgtcgagatgatatcgtatatttcgcagagaaatattgtgctattacacacatcgactacgggaccattaaggtccaacttcgtgattaccaacgtgatatgcttaaaatcatgcactcaaagcgtatgactgtttgtaacctgagccgtcagttaggtaaaacaaccgtagtagcaattttccttgctcactttgtatgctttaacaaagataaagcagttggtattcttgcccacaaaggctcgatgtcagcagaagttttagaccgtactaaacaagcaatcgaactattgccagatttcttacaaccaggcatcgtagaatggaacaagggttcaatcgagcttgataatggtagttccattggagcttatgcaagttcccctgacgccgtccgtggtaactccttcgctatgatttacattgacgaatgtgcgtttatcccgaacttcattgatgcatggcttgctatacaaccagttatttcttctggtcgtcgttctaaaattatcattacaactactcctaacggattaaaccacttctatgatatctggacagcggctattgaaggtaaatcaggctttgctccttataccgcgatttggaactctgttaaagaacgtttatacgacgataatgattgctttgatgatggatggcaatggtctgcacaaactatcagtgcttcgagtcttgaacaattccgtcaggaacatatggccgaattccaaggtacttccggtacgctgattaatggtatgaaattagccaacttgtcttttattgagacaactcctgaaaatggttatttctatcgttataagaaacctgaagaagggcgtaaatatatcgctgcattagactgttctgaaggtcgtggtcaggactaccatgcaatgcatattatagatgtgacagattcccaatgggaacaagttgcagtactccattctaatgaaatttctcacttaatcctcccggatatagtgcataaatatctaatggaatataacgaagctcctgtttatattgagctgaactcgactggtgtttctgtagctaaatcactttatatggaccttgagtacgaaaacgttatttgtgattcaatggttgatttaggtatgaaacaaacaactaaaaccaaagcggttggttgttctacattaaaagaccttatcgagaaagataaattaatacttcatcacaaacctactatttttgaattccgtaccttcagccagaaaaaactttcatgggctgcagaagaaggtttccatgatgacttagtgatgggtttagtaatttttgcgtggctaacgacccagcagaaatttgccgactacgcagacaaagatgaaatgcgccttgcgtcagaagtctttagtcgtgagttggaagatatgaacgatgaatacgctccagttgtttttgttgattctggtgacgcttcagccgaatatgctccaagagaacatggcttgtcgtttgtataaataagataaagcaaactatttgaggaattaaaatggctttattatctccgggcgtagagctcaaagaaaccagtgtacagagcactgtggttcgtaatgctacgggtcgtgctgctctggttggtaaattccagtggggtcctgcattccaggttgtacaagttactaacgaagtagaacttgttgatatgtttggtggtcctactaatgaagttgccgattatttcatatctggtatgaacttccttcagtatggtaatgaccttcgtactgttcgtgtggttaaccgtgacgttgctaaaaacgcatcaccggtagcagggaatatcgaaacaaccattctcactgctggtagtaactataaagttggcgacactattcgtgtcaaatatctccagaccgttatcgaagaagatggtaaagtaacaaaagtagatactgacggtaaaattcaggctgtgttcattccatccggcaaaattatcgctcatgcgaaatccgttggtcaatatccagcattaggttctgcatggactgctgaaattacttcttcaagttcgggtgtttctggtactatttctatcggtaaaatcgtaactgattccggtattctgttgactgaagctgaatctgctgaagctgaaattacttctttagacttccaagaatctctggctaaatatgcaatgcctggcgttgtagctctttatccaggcgaaatcggttctactattgaagttgaaattgtttcttatgccgatttccaaaaaggtaatgccctgcaattgcctatttaccctactggtggtactcgtgcttctgtagccaaggctattttcaactacggcccacaaactgaaaaccaatatgctattattgttcgtcgtgaaggcgcagtagtagaaaacgttattctgtctactaagcgtggcgaaaaagacgtttatggtaataatatctttatggatgattatttcgctaagggcacttcaaactacatctttgcaacttctctgaactggcctgctggtttcagcggtgttattcagatgcagggtggtgtttctgcaaacgatcaagttaccgctggtgacctgatgcaaggttgggatttgttcgccgaccgtgaagctcttcatattaacctgttgattgctggtgcttgtgccggtgaaggtgatgcggttgcttctactgtacagaaacacgtcgtaagtattgcagacgaacgtcaggattgcttggcatttatttctccacctaaaggtctgttggttaatgttccactagctcgtgcagtagacaatttaatcgattggcgtggcggtaccggttcatttgacaccgacaacatgaatatcagctctacttatgctgctattgatggaaactataaataccagtacgacaaatataacgatgtcaaccgttgggttccattagctgctgatatggcaggcttgtgtgctcgtaccgatgatgtttctcagccttggatgtctccggccggttataaccgtggtcagattctgaacgtcattaaattggctattgaaccacgtcaaactcagcgtgaccgtatgtaccaggatgctattaacccggttgttggttttgctggtggtgatggctttgttctgtttggtgataagactgcaaccaaagtcccaagcccaatggaccacatcaacgtacgtcgtctgatgaatatgttgaagaaaaatatcggcgatgcttctaaatacaaactgttcgagttgaacgacaacttcactcgctctagcttccgtatggaaacttcacagtacttagaaggtattcgtgctcttggcggtatttacgaaggtcgtgtagtttgtgacaccacgaacaacaccccatccgttattgaccgtaacgagttcgtggctagcatttatgttaagccagcgcgcagcatcaactatatcactctgaacttcgtagctacatctaccggtgctaacttcgatgaactgattggtccagcctgataaacgccagggctctttaattagggccctgataaatctattggctgttgaatttaaatcaatcaggcgccgcctggcaacgtataaatatacaaagagagactacaatggaattaacagatatcactcgcgcgttcgagtcaggtgactttgctcgtcctaacttgttcgaagtcgaaattcctttccttggtaaaaacttcagcttcaaatgtaaagctgctccaatgcctgctggtattgtggaaaaggttccagtcggttatatgaaccgtaagattaacgtcgctggtgaccgtacatttgacgattggactattaccatttacaacgatgatgcccatgacactcgtcaggctattgttgattggcaaaacctttgccatggtatgactaatgaaatttctggtgcagcacctgccgattataaaaagacggctattgttcgtcaattccatcgtgacggtaagcgtgtaaccaaagaaattactatcaccggtttatggcctactaatattggcgaagtccagatggactgggacagcaataacgaggtagagacattcgaggcgactttcgcaatcgactggtgggaataaggtaataaatagatatatcaaggagcttcggctccttttcccaaaacttcggagactctaatggcaggatttaataacggcattttaagtatttttgctccttgggcaaaagccgatgagaacgaatataaagaacaaattaataatgacttggagtccatcacagcaccgaagtttgatgatggagctcgtgaaatcgaaacgaatgaacgagaagttccatataatgcgcttatgcaacagatgttcggtaataacgaaccgactcttaaaaatacgcgtgaacttatcgacacatatcgcaatttgatgaataactacgaagtcgataatgctgtggctaatattgtttcagatgctatcgtttatgaagatgaccatgatgtagtggctcttaatttagacggtaccgattttagtcagaatataaaggaccgaattcttgatgagtttggtgaagtactaaattgccttcacttccaacgtaaaggtactgaccatttccaacgttggtatgttgactctcgtattttcttccataagattgtcgaccctaaaaacctcaaagcaggtattcaagaacttcgtcgtttagaccctcgccaaatgcagttcgtccgtgaagttatcactaaagacgaagctggcgttaaaattgttaagggttataaagaatatttcatttatgacactggccatgaaagctatgcctgtgatggcagaatttacgaagccggaactaaaattaaaattccaagatcggccatcgtttatgctcattctggtttattgtcatgctgtggaaaaaacataattggttacctgcatcgagctattaagcctgcaaaccaattaaagttaatggaagatgctttagtaatttatcgtattacccgtgctccagaccgtcgcgtattctacattgatacaggtaacatgccttcacgtaaggctgcagcacacatgcaacatatcatgaacacgatgaaaaaccgtgtcgtatatgatgcaacgaccggtaaaattaaaaaccagcaacacaatatgtctatgactgaagactattggctgcagcgtcgtgatggtaaagcggtaacagaagttgacacaatgcctggtgcaaccggtatgtctgatatggatgacgttcgttatttccgtcagtgcttataccgtgcattacgtattcctgagtctcgtatcccttcagaccaaaatagtggtgtgatgtttgatgccggtgcaactatatcacgtgatgagttagcatttgctaaatggattcgtcagctccaaaataaatttgaggaaatcttcctcgaccctcttaaaaccaaccttattctgaagaaagttattacagaagatgagtgggacaaagagataaataatgttaaagttgtgtttaaccgtgatagctatttcactgaaatgaaagatgcagaaatcatggaacgcagaatcaatatgctaactatggctgagccgttcgttgggaaatatatttctcaccaaacagctatgaaagatttccttcagatgtctgatgagcaaattaatcaagaagctaagcaaattgaattggagtctactgaggctcgtttccaaaacccagatgaagaagaagaggaattctaatggacgatttaattcaagctattaaatcaaacgacctcgtcgccgttcgcaaagtatttgaagcgcatatggcacctgttgtttccagtttgattgaagctgaaaaaatcaaaatcgcacgttctatcatgattgaaggcgaagagcctaaagatgaagacgatggcgacgataaagacgaaaagaaaaagaaagaagagtctgatggcaaaggcgctgattccggcggtgatgctgatgaaggcgacgacgaagacgaagatgaggacgactaaatgtatcttctccctgaaagctatgaattagtaacggaaaatgttgaaaacttaattccagaagcgcagggtcgttttgatagtctttctaaagcacttgataaagctgatataaataaacttgtagagaacatgtttgagagtggtgatgttgatttagccatcgctcttggttctattaacgaagaaatggctttaaacgaatttatcgttaaacacgtttcttctcgtggtgatattacgcgtactaaagacattaaaactcgtcagcgtaatgcataccaaactacaggtctttctaaagctaagcgtcgtcaaattgctcgtaaagctactaagaccaagcgctctaacccatcaactcaggttcgtgctgagcgtaagcgtaaaaaagctcgtgcgaaacgtaaagcatttggattaagctaatgaatgaaccccaactcttaatcgaacattggggtcaaccaggtgaaattatcgatggggttcctatgttggaatcctacgatggaaaagatacaggcttagctcctggtctatacatcgaaggtattttcatgcaggcggagaaagtaaaccgaaataaacgtctttatccaaagaaaattttggaaaaggccgtagccaattatatggcagagcaggttgttactaaacaagctctcggcgaattaaaccatccacctcgtgcgaacgttgaccctatgcaagcagccataattatcgaagatatgtggtggaaaggaaacgacgtatatggtcgtgcaagaattattgaaggtgaccacggtcctggtgataaactagcggcaaatatcagagctggatggattcctggagtgtctagtagaggcctaggttctttgacagaaaccaataaaggttataagctggttaatgaaggatatcgcctgacggttggcgtagacgctgtatggggtcctagcgctccggatgcatatgtcaaaccaaaacaaattaatgaaagtgcggaaaatacttccgatactagtgccgatgacgcctacctggctctcgcagaggccatgaaagcgttataaatattattatctaaacaacaggactacaaaatgcttaaagaacaactgatgaccgaagcgcagaatattgacgtttccgttgctcttgacagtattttcgaatcagttaatatttctccagaagctcgtgagacttttggcactgtattcgaagcaaccgtcaagcagcaggctattaaactggccgaatcccacattgaatccatcgctgaaaaagcggaagaaaaagttgctaaggctaaagaagaagctgaagagaaagcagagaaagatattcaagaatctgttgctcgcttcttagaccatctgggtaaagaatggctggctgaaaataaactggctgttgaccgtggtattaaagccgatctgtttgaatccgtaatgggtggcatgaaagaattgttcgtagaacacaacgttgtaattccagaagaagctgttgatgttgtagctgaaatggaagaagaactggctgaacagaaacaagaaactgctcgtctgttcgaagaagtaactaagcgtgatgcatatatcaattatgtacagcgcgaaaccgttctgggtgaagcaactcgtgagttgaccgaatctcaaaaagaaaaagttagttctctggtcgaaggtatggaatactcagattcattccctgctaagctggacgctattgtaaatatggtaaaaggttctattaccgaatccggttctaatgaaaaaccgattaccgaaggtgctataaatacacctgaagatgatgctgcagctctgaactttgtttcagaaccggtcgtcgaacaggctcaaaagcctgcaatgtctttagctgacatggctgctcttgcagcatcacgtatttcttaatttaacaaggttattatcacatgaaaaagaatgaactcgtccagaaatggcagaatctgttggaaaacgaagcactgccggaaatcgtaggcgcttctaagcaagctattattgctaaaatcttcgaaaaccaggaaatggacatcatgaattctccggaatatcgtgatgagaaaatcgctgaagcattcggttccttcctgactgaagccgaaatcggtggtgaccacggttatgacgctactaacatcgcttctggccagacctctggtgcagtaacccagatcggtccagcagtaatgggtatggttcgtcgtgctattcctcatctgattgctttcgacatctgtggtgttcagcctctgaataacccaactggtcaggtattcgccctgcgtgccgtttacggtaaagacccagttgctccaggtgctaaagaagcattccacccaatgtacgctccggatgcaatgttctctggtaagggtgcagcaggtgctaacttcccagctctggctgcaggtactgtgaccgaagttggtaaagtttatcgtcatgacttcgcacaaaccggtactgcttacttccaggctaccgaagttgttactgttgatgctgccgctaccgatgctgctaaacttgatgcagaagttctgaaacaagttgaagctggtgtgttcgctgaaatcgcagaagcaatggctacttctatcgccgaactgcaggaaggcttcaacggttctagcgataacccatggaacgaaatgggcttccgtatcgataaacaagttatcgaagctaaatcccgtcagctgaaagcaagctactctatcgaactggcacaggacctgcgcgctgttcacggtatggacgctgatgctgaactgagtggtattctggctactgaaatcatgctggaaattaaccgtgaagtaattgactggattaactattccgcacaggttggtaagtctggctttactaacaccgttggttctaaagctggtgtgttcgacttccaggaccctatcgacatccgtggtgctcgttgggctggtgaaagcttcaaagctctgctgttccagattgacaaagaagcagctgaaatcgctcgtcagaccggtcgtggtgcaggtaacttcatcatcgcttctcgtaacgtagttaacgtactggctgcagttgataccggtatttcctacgctgcacagggtctgggtcaaggtttcaacgttgacactactaaagctgtgttcgctggtgttcttggtggtaaataccgtgtgtatatcgaccagtacgctccacaggactacttcaccattggttataaaggtgctaacgaaatggatgccggtatttactacgcgccatacgttgctctgaccccactgcgtggttctgatccgaagaacttccagccagtaatgggcttcaaaactcgttacggtattggtattaacccgttcgctgatactgcggctcaacagcctaaaggtcgtatcgttaatggtatgcctgatatcactaacagcctgggtaaaaacggttacttccgtcgcgtgttcgttaaaggtatctaatccttttaaaaaaattatgggagacttcggtctcccattcttgtttctgtacctttataaataatattattatccactaaggaaaagcgcaatggctaaaatcaacgaacttctgcgcgaatcaactacaacgagcagcatccaatatggtcgtccgaatctcgttgctttgacacgcgctacaaccaaattaatttacagcgatatcatcgcggaacaacgtactacacagccagttgcggcattgtacggtgttaaatatcttaccccagataatgaattcagcttcgcaaccggtgctacttatggtggtcaagtaggttctaaagatagagaatctattcctaagctgacttctaaagcccagagcattgcacagggcgattatttcgtatacgagaacattgtttataaggcactcgaagcagaccccctggcgacgactagcgcaacagagctagttgatgctcttaaagaagctttagtccttttaaaatgccgtttagttccggatgctgctagtacttctaaattcgaagataaagatgtagaaatcagtaatgctgtatttgaagtgaataaatggaatgctccggtcaaatctcgtaagcttaaaacttctctgactgtagaacttgctcaagatatggaagctaacggctttgacgctcctgcattcttagaagatttgcttgctactatcatggctgacgaaatcaacaaagatgttcttcaatcattgattaccgtttctaagcgttataaagtccaaggactttgtgagaatggtattattgatttgtcttatgataattcacctgaagcatcaagaaaattatacgaagtcgtttgtgaaatgaactctgaaatccagaaaactacttcatattcaggaacatttgttgtagcaagttctcgtgccgctgcattgcttgcaggttctggttggttaaaacatcgccctgaagatgatgaatggcttccatctactgcatatggctatctgactaatgggctgcctgttttctgtgatgttaacagcccattagattatgttacggttggtgttaaagaaagctatggcggtaatgaaatcgtaggttctattttctatgctccatacactgaaggtcttgatttagattctaaagaacatgttggtgcatttaaagttattgtagacccagattctttacagccgtctattgcactgatggtgcgatacgcattatctgctaacccgtatactgtagccaaagacgaaaaagaagctcgtattattgatgctaccgatatggataaaatggctggccagtctaacatgtcatatctgcttggtgttaaacttccacctattatctacgaggcataatatggccaagattaatgatttaatttacgaatcaactttgacccaggcaaacagcttgggtcgccctagcttgctgtcttatactaaagctacaaacaaaagaatttttaaagctcttgtggcagaacaacctacgacacaaccagtagctgccctttatggcatcagagttctgaaccctgaagatgaaatgacatatcttggtggtgctacttttgcaggtcaatttggaatgcccgaacgtgcagctgttcctgaattaactgcattatcaggttattctaaaggcgatttttttaagttcgaatctgttattttcaaatgccttgaagatgacccatttgccgggaccaccgaaactgatttaggcgaaggtgtgtctgaagctgttgcggccggacatattcgtatgatgtctgatgcagcggttacttctaagtttgaaagtaatgcccctgaaatttctgaagcaggcttcaggattgataaatggcagactaatgtacgttcacgtaaacttaaaacttctcttactgtagaactcgcacaggatttagaggctaatggttttgatgcccctgatttcatcgacaatattttagcaatccaaatggcagaagaaattaacaaagatgttcttcagtcactgattactgtttctagtcgatttaaggtccatggcgtgtcttctaaaggcgtgttggatttaactgatgctctttatgataatgcccaggatagagctcgtgcactttattactatatgtgtgaaatgaactctgctgtgcaacgtaatacttcatttgccgggacttatgctgttgctagttcccgttgtgctgctattttagctgcatccggttgggtagaaaagaaagacgatactgaccccctggcatatggtgtgcttaaaaatggtcttccattatatgcagacgtgaatagtccttgtgattatgttatcgtgggtgttaatgctgatttgggcgatgggcagactgtagcttcactgtattacgcaccgtatattgaaggtgctgatgatattcaagaggaaagtgatactccggtaggttctcacaaagttatcgtggacccagattctttacaacctgtagtttctctgttaagtcgttatgcactgtctgcaaacccttatacagtggctaaagatgaaaaagaagctcgtatcattgatggtgcggatatggacaagatggcgggtcaaagccaattgagttcttatcttggtgttaaattaccaccgttagaaaaagaataagggagccattggctccctttttcgtattactcgtctgaaatcagatattgccatacatgacgaagaacgtcttgagtggttttgataatagctttcttaactaaatcaggattatcagccgttgtcagaacaattccttcacgttcagcctcttccaacagatctttaacagtcagacccattactttgccgaaatctttaggacctggcttaccaatcttgctcacaacgttattaattcggtttacattgatatatgattcaaagtcaaaataaactttattatcttgttctgttaactcaactttaggcttaattggtttatcagattttgatttttcactgaacttagagttcttacacttaatagccacacgagagccattagggaagaacttaggataacaaggcttcagaacataaccttctgcgacattcttattttccacttcaacttggaatggagtgctattagcttcttttagcccatgggcttcaatagctttattataacgatggacaactacatccaggtcattaggtagtttagataattcatcaaatttaccgcggccaagcaatggggctaatttgaaaccgaaagtattacaaatctgttccatcatataatcgtctacaaactgattagtaccttctgcggttttaaccaggatatcgaatacgtagaaatctttctcgccataatcaacacccttctgaattccaccacctgcaaactcaccgaaaatctgcatcgacgagccttctttaatagtgtgctgaacagccttgatactgtcattatatttcttcaggacaatttcataaccaaagaaatcttcacctgctaagataggaccagtgcgcttcgcgcatgtgactgcgtcacgttcaattatgatagagaagtttgtaccgtgaatcttctcacgtgctacccatggttcagttacatcaaaaccagcattacgaatcttctcaatgaacttaccgttgtagtggttctcaagactggaatatttctcaaacatatattaccttataaatatcattataaattagaaagagagcaactaatcttcttaccaccaatcactctcaacttgtaaaccattatacctaatatatcacaaaaattcttaaagcatattagaaaacaatttcgacccaatcaccatcgcgttggtcgtgtttccaattcaccattacaccgtcatcttgcatccatttagtcaactggtctttgtatttctttgccagggctgatgggtaccagttaaattggcgtttacctttcttagcctgagccagaaattcctgttcaacttcatctttcgcctgtttaagctcatctgaagcgacaaagtccgccagggcaccgtaatgtgttgctaatgatgtaatacgttgctctttagtagatggcttcagaccgccaataggatggcctgcctcgtcccaaccttggatacgacgttcacttttaaattgttcagaaggaaacattgggtcacgcattgtagcctctcattttctcaattaatttagtgtggtccgtgatgtatcgtttacgataaacaactttctcacggttctttgcacgttcctttgccttctcaactttcatccaatcctgcatagcttctttagcactgatgccgaactgtttagcaatatcaatgaacgtgacaccgttctcatgcatcatatgaatcttaattgctttcatttcatatctcacttgtgaatgtagagctattaaatcatgtatttttaaagcaagaaatttcttagtggtaggaaggctgagactgtaggatatagcgggccgaagcccgctataaaattatttgagtgttacgaaagatgagttgcgtgtttctctaacaagaatagaaccatctctataaatgtagtagagtaagctgaatagcgtctggtgcgcgctaggatgagggaagctggtaggtcgagatttccaatccggagtctctttaatccattggtaaatccaccaaggtagagttacatagcctggatttttgcccatcagaataagatgaggactaaagtcagctggtaatttaaacggctcagatttttccgattcaacaatttgagctacagcttcttcaattgtattttcacttaaaactggctgtggttcaagcacttcaccaataggagcttcaacatggagttctttttctgggatttgaaccggaacttcaattactgatggtgtttcaaacggagcatcaaacaacagaaccgcttcttctttagcttcagtttcaccttcaatatgagctttagcgccactgatttcgtcatcagcgtcaatcaaatcactgatactcaatccaccttccacttcatcaactggttcagcagcaagttctttaagaccggcttcgatgtcaattactagattatcaaaacctttagattttttgagttgaaggccaaactgttctgcatattcaataagtttagccttagcttcttttttatcgtctaattgacggagttcttcaatatactggtggtccataatcattctcttttctagtgtataaatatgtatgtatttataactagagaataccctcatgcaaattaaagttcattttgaaaattttagtcatgtacgtattgagtgcgatgaatccactttctacgaactaagagactatttctcattcgaagccgacggctataagtttaaccctaagttcaaatatggtcagtgggacgggagaattcgtcttctggattataaccgtatgttaccatatggtctagtcccacagatgcgtaaattcgcagaccaatttgaatacgaattgtggattgaccctaaaatcaccgagaaagaagaaatcactcgtgaagggtttgactcatggttatccgaactagaaatttattcaggttcaactaagattgagcctcattggtatcaaaaagatgctgtgttcaccggcttgaccaacagacgtaatatcctgaatttacctacatctgcaggtaaatcgttaatccaggcgcttctgagtcgttattacgtagagaactatgaaggtaaaattcttattttagttcctactactgcactcgttgaccagatgataaatgactttgctgattatcgtttattcggtaaacaacatatgctcggtattcgtgctggcacgaaacgtgattcggatgcaatgatttacgtcagtacttatcaaactgcaattaaacagcctaaagagtggtttgcccagttcggcttattcatgaatgacgaatgccacttagcgacaggtaaaagtatttctaccattattgaaggtttaacaaactgtatgtttaagttcggtctttcaggttcactgaaagacggcaaagccaaccttatgcaatatatgggcttgttcggtgatattttccgcccggtatcaacttcacaattaatggatgaaggcgccgttacggaccttaaaattaactcaatattccttcgttatccggatgaattctgcgttaaaatgaaaggtaaggactaccaaaccgaaatcaaagttattaccaaagcggaccgtagaaataaatgggttgctaatctcgctgctaaattggcaaagaaagatgaaaacgtgttcttgatgtttaagaatatcgaacatggtaaaaaattggtagagttggttaaagaggccggtgcagaaaaagtctattacgtttcaggtgaagtcactactgaagttcgtaacgctttaaaagaaatggccgaaaacggcaaaggtattgttgtggttgcgtcgtatggcgtattttctacaggtatcagcgttaaaaacttacaccacgtaatttttgcacatccggttaaatctaaaattattgttctccagactattggtcgtgttcttcgtaaacatactagcaagaaagttgctcaggtctgggacattattgatgatatgggtgttaaacctaaatcagtcacggccaagaaaaaatatgttcacttaaattatgcattaaaacatgcactagaacgtattcagcgttatgctgacgaacaattcaactatgtaatgaaacaggtagaaatctaatgaaatcatttgccgatattatctatgaagctagtattgatagctttatgtctaagattggctcttgtcagaccctagatggtctgaaggagctcgaaaaatattacaaaactcgtgttaaagaaactgatttgaaggattctgacgatatcagcatcagagatgctttagaaggtaagaaagtagaacttacttctatcgatgatgaggaagaagaggaattttaatacaaaaaagccccaaccaaaaggaaggggcaaaaccaacaagttggttatctcactagattaaaagctgagtctcgtttaactgctcttcggcagattccgttaccggtaaactttcagcatagttataacattggccaggatggcatgggcctcggtctgattcaacaaccaatgcatcgtcgattggcgttttacagacaacacaaatctgcgacatgattgtctccttagttgtttgtatatgtttatttattacgttttaaagccgcattaataaattcttggaatttacgcatacgttcttcagatggtttagggcgcttattaattaagcctactttacgacatggcattatttttcacctgcttcgaatttacggatgtctaacatcgttttcagtgagaatccacgagccttgattgcatcaagtgctgaactacaaaaatcttgcaacaatccccaatactgcatttgagtatcaagttttaagatgcttgaatctgcggccatcacagtcttcatttcagtaggcgtatattggtccatacagacttcttcgccaggctcacttcttccggaatagaaatctaaacgctttttagatgcagattttttctgaatctcgatacgcataatttctttcttacaattactatacagacgtaaccacttactgtgtaacagcacgttgtgctgtacttcatattgtaatttcgtcccgtcgataactaaatctttatctaactcttcttggaacgcctctaatttaaattctagtgccataatgtttcctgttgtttaacccatagacccattataacacaaggcctatggacagcaattaaccaccacttctgagctggattctaatttgctctaaagtatctgggtcatcgactattgaaaagcgaaccgtaacaattattgagttgtcatcatagattggcgtcacttgaacacccaattgagacactcttggctcgaagtttttaatagcagaaacaatattacgctgaatagtatcggccaccagaggtgtcatattttcaaaaagctggtctgttatatcacaaccaaattcgggttggaaagggcgtgagccctttcttgtagtaacgataccgagaatactgtttttaactgcacgtgcgcctactactttagcaacatcataacgatagtctttctgcatattaggcgacaggtctgagtacattttattgatgttcattatatcaacttaaagaactctttaagccccttgacaacatgaatttcgttatggccgcactcacaagagataggcactgctaattggacttgtggttcagtcaaatgagcgaaaatcttttcaatatcttctactgtgatagcagaataaagatcgtttacttcttcatctgataagtcgtcagggaagatttcgacatcatcaggggtaacaatagaatgaatgcattctgctacggtttgggctttatatttgtcttggaagatattaggccatctgaatctaattttgaagttagtaaaggcccagacaacttccctggcttctgtagtgctcgcctgaataagattcattggaaccatttgttcccgcccacaggcgcaatgccacggacgttctacgttaacttcacctaatgattgggcccacagcttaaccagcaataattctccttcatggcgagggagttcaggggcgtctgtacatttcttaaacagttctaaaatttcttcttcaagtcgcccttcgagttttgcctttaaaaggtctttatattcacgtaaagtgaatgcacgacaattgatggtcttgtcaccaatcttcgtcacaaaattatagttcatagttggctccttaataagcgtatttataaatacacgaaaggagatacttatggcaaatataatcagatgtaatatgccagatggtatccatcgtttcaaaccgtttacagtctcagactacagagatttcttattggtccgaaatgatatggataactatccggaagacgaacaacaaaaattaatggatgaattgctagaagattatttcggggattatcctgaaagctggcgtccatatcttttcatccaagtgtttacagcttctattggtaagactaaaattccggttgcattcgaatgtaatgaatgtggtgcttctaagcaacgactttttaacttagcgcttcctccactaaaagaacctgaactagaaacagctggggttaagataaaatttaaattccctgataaagattatgaagacaagacccaaatgattttagaaaatataaagtcggtcgaagattcagacggtgaatataagtgggaagacataccggaagaaacacaaatccaggttattgacgctatagatttagaatctttagagaagcttataactgaaatgaaaccattccatattaagtttaaatatggctgttgtacacaacatgttgcttattatgataaaatggtggatattttaaaaatacttttaaaccctagtgaagtatttagtttttatcaaataaatcatctgttagtaaaaagccactacacattagatagcataatgtctatgcttccaattgaaagaaatatcgcgttatccctagtagaaaaggaccttaaatgactaacaaatctatacaacgtgaaggttatcctaatataagcataaagctttatcaggactatgacgcatggcaaactaaccgttttgtagagttagctgcaacctttactacattaacaatgagagacgggcttaatggtattaatgaaggattacttcaattttatgatgccaaaaacctccatactaaaatggatggcgaacagataatccaaatatctgtcggtaatgccaactctcaaagaacacaaacaaggatttatggttgtaaacatttcgcagttggcgttgactctaaaggcgataatattattacaatccaacttgcaactattcattctttagagaaccttaaatttggcagaatgtttttcccgtcagtccaagaaacacttattgaaatgctcggcgtcatttaccaagaccgtacattacttactcctccagtgaatggaattaacgtgtatgtgcctaatgtcccttggtgtgacaatataaaccgttatatggccttcgtccgtgaaatgggacttgctgttgaaagtgaccaattcgtattttgttgggaagatattgatggtatagaaatcatggactaccaatatatgattgaacaggagccattgaaattcgcagtgggcgagccaaggcttattggtcaatatgtccaagatttagaaatgcccattgcatttgattttgaatggatgactaaggccaaccaacatactaaaaagccgtatcagaacgctactttatatgctcattcatttttagacaaaaacgctacgcgtgtaacattcggtgaaggtcagaacagtatatttgtttcacgttcaggcgcatacgccgaagcaacatatagaaacggctatgaagaagctaaccgtattattactatgtcgcaatacgacggttatgcaaagtgcaaagtatttggtaattttgaagtaactcctggtgataagattaatttctacgaccctaaaaatcagttccaatttgatttttacgtagacgaagttattcatgaaataagtaataacacatctatcactaacatctacatgtttacgaatggtactccaatcaaagttgaagaagtgcctaaggttaaaaatgaacttaaaacttattctcccgatgaagaaaatactgatgaatcagaaggaaatcagtattccaaaactaggcttaaaacatcataatttggttaaagatgaaaaagaccctgtaaaggcccttcgcatgattatgcgaactattcatcctgatttagatgcagccgaaactgattttgtatctttacatcttttagaattcaacggtaaattaaagagtgaagtcgttaaagacggctttacttatcgtttagctgatgtttatatttgccaaagacttgaattccaatatcaaggaaatactttcaaattcaggtcgcataaaccgtttgaaacgtttgggcctgttgatgcagttttgcaaactctttatctcggtgacgatgtaccagattttctggatatgcctgctttcgtagctaaatgggcagatgatataacaagcactgtagctattcctggtcctaatggtcctattaaaggaatgcttgaaataatggaccttttaaatgtcgaataaatctgaacaacagagctttcgtcgtagaaagattattgaagagtcggctcctcagcgtcgtgctgaggccctggcttccactcaaaacgacgaattaagtaatattggttctcagctacaagacgtccaggcggccacagagatggtcgctgaaggcattgaacaacaaaccggagtaatacaaacatcattagacaaaattggtaaaaaggttgatgatattgaggccggtgtagaacttgtagcagaatcatccgaatcaactgcagcagcggctaatgaaacttctgcagctgcaaaagctatttcaaataagttggcaaaactttctgaaatgctttctgctaaatttagtgcagaccctagtcgtgttccacaagcaactgaaactgcagtggctgcggtcgaatctaatatgcctatgccggttgaagaaccaaagcttagagagctgttagaaaaattaatcccaggtgatgcgcctgctgaagacgctccgttccttcctcctgtggttcaaccaccggaagaagaacagaagcaagataaaccttctaaacaacctccaggtggtggtaaattagatgaccttttgaaaacaactaaaaaaggatttggtgctgttgtaagcgttaccgaccgaattgcccagatgcttttcaaatacactattacggctgtagcacaggctgctaaatttgctgggatgttgttagcattagttgttggcatcgatatgattcaagtttatttccagtacttcatgaaagagtttaataagtcgtgggatgaatttgataagaaattcgaaaaatgggggccattgatatcagaccttttagtgatgactaaaaacgtgtctaaaatgtttgatgaaggaaattggtttaaattagccgaagctattgtcaaaggcatggttaagcttaccttgaatatggctgatatcttaatgcttggtattggtaaattaacggcatcattattacgttctcttggttttgatgaaactgccgataatatcgaaggtggcgcattaatgacataccagcagaattctggtgctgcattaagtgaagaagaccaaaccactcttgctaaatatcaagatagaaaagatgctgaagcatatgaagccaaagtagaatttaatggcggattcaaaggtaaagatgaaggtcttaaagaggctcaaagatacggaactgtaacaaaagaaaccgctcaagaaattaaagctggtaaagtcgattcttctttccgtgatttacctgaatctcaacgtcttgaaataattaaaaagcgtaatgaaactgaagctgctgcccgccgtttggctaatagagctgaagaaattatgtcacctgacgaaagagataaagagaactttaagaaagaaaaagaacgtgttgatactcttcttaaagaccctgctattaagcaagatccggcccttcagtcattaataaagaaaatagatttgaacgctaagaaattcgataaggtccctgtccaggcacaacctcctgaacaaaaagaagaaactattcaggctaaacaagttatggaacgccagagggctaaagaagctcagaaaaataccgccaatgatggtaaacttgggaatcttattcaacaagttaacgttcagaaaaataataagacaatgtatactatgcctgctcaaacctctatagcagacccgggtatgcatcgttctgtaaatgtgaactaaggaattaatatgcaggtaaaagaattaacagacgtagtaggcggttggaataccggtgaaaaaatatctgccgggcaatctaaaatcgctcctatccaaaagaccataagtgctcaatatcctgcagaacgttcttctggtaatgattctatcggtgattttagagtttatgatctttataaaaatgggctgttatttacagcctatgattattcggccagaacaacacctgatatgaggtcattaagagaacagttccaaaggggattaggtagtggtaacttcaatccattaaaaaactttattagtgggtcatatacaacagacaagtttaatagtactccggtcgccaacttgttattaccacgttctaagtcagacaccgattctgttagccatcgctttaatgatgttggtgaatcacttattactaaaggcggcaattcggccacaggtattttaagtaacgttgcatcaacatcggtgtttggggcaatagaaagtattacccaaggcgtaatggctgataatggtgaacaaatttatactactgcacgtagtatgtatgccggtccagataaccgtactaaagtatttacgtgggaattaactccacgtaacgtacaagaccttattcaaattatcaaaatctatgaagtctttaattacttctcttacggtgaaacaggtaactctgcatttgccgaagaccttaaagaggaaatagattcttggtataagtcgaccttctttaaaaaagaagctatcgaatcatttgatggtcaattagtaggtgaacagattacttcattcctttctaaggttattgttgtaagtaaccctacagtatggtttattcgaaactttggtactacgagttcatttgatggacgtgctgatatatttggaccgtgtcaaatccaaagtataagattcgataaaactcctgatggtaatttcaatggattggcagtagctcctaacttacctaacacgtttgttctggaaattactttccgtgaaatccttactcttaaccgtggtaatttatatcttggtggtattcaataatgtttacattacaggaatttcagaaccaagccgctaatatagactttcaacgtaataacctgttcagcgtggtcttcgcgaccacgccttcttctaaatcacaggcattacttgatcagtttggtggtgctttgtttaataaccttcctgttgatactgatttctttggtattacacagggcgaaattactcaaggaataactacattagttactgctggtacacaacaattgattagaaaatctggtgtaagtaaataccttataggagcgatgaccaatagggttatacagagtttattaggtgagtttgaagtaggaacttatttgttggacttctttaatatggcgtatcctaccgcaggtttaatggttcacactgtaaaagttccagacaaccagttgaatcatgaaatggatttaaaccataatgcgcctaacattaaaataactggcagagaatattcgccgtttgttttaagtttccgtatggactctgaagcttctaactatagggcatttaacgattgggttaacgctgtacaagatccggtcacaggattacgtgcactgcctgaagatgttgaagctgatatccaagttaacttgcatgctcgcaatgggcttccacatactgtcataatgttgcaaggatgtgtccctgtgggcgtcagcgcccctgaattaacatacgaaggtgataatactattactacttttgatgtcaccttcgcgtacagggtgatgtctaccggcgccgtaggaaaacaagcagcaattgaatggcttgaagataaaactattaactctattactcaaattaatggtgaacgttcgttgagctctcaattagccggattaagcagactatcaggtgctcagtcaggaatgactaacttacttaatggatttggtagtggtgggctgaacgccggaataggaaggatagttgggaccgggactagcaggttattctaacgaaaaagggagagcttttgctctcccttaggggtttatttacggaagcctaagaacgcagggatggtaatgtctggctcaggaagttcatcagccgagttgaaagtatcaaatgaatcaatgtcaataaagacatcaattactactggtgcttcactttcaaattggcctgtaataataccagtgaagatattatcggtatgctcttcatttacgaagtttgccactggacggatgttgaactgagccttttcaccaaacactttacgaagttctgacacaactttttcattgaaagccgcgtctactggacgtacatcttcaacataagcttctttaccatttactcgaatgaatgaacgcattttgatatcctcacttgtgattgagattacatcataacacgttcatttgggcttgtaaactactctacaaatttaggtggagtgtcttcaatgtcgatgaaggaagcaagcaaaccaagacctacagcagttgatttaacgaatttactgaagtctactgcgaccggttcaacttcgtccatgtccatagcaaccagttcacccgattctaaaagagcatcaccgtcataaacaaccatagattcattcagtgcatcagccgtcataacttcagcctggatgaatttctgattgctgtagaccatgccatcgttataggaagcatctgtgatcttattaatctgaagcatagtaccacgcggcagaataacttccatttccccagccatattgctcaggtcaccggggtaaacaacgttaaccttatgtgcaccttcaatcgcccatcctaacgaaacgcgaatacgttcttcaccatattcttggaccattctaatttcttggtccggaacaatagcggtttcatctgatttatcaaccgttaaaacagcacgagtattatctgatgccattgctactgcttgattacctttccaaccaccaaagataattggggctaatgaagtagaaacaaagttacggaaatagaatacacggttcttaacgagagcctcgaaaataggcttacggacagtttgtgaacgccataatgtcaggccttctggtaaacgatcacctctcttgaaagcatcatcaagatttttaatggccgtagtaacttctttttctgttaatgtatcataattagcagcatcataacgacctaaaagcatattattaatatcggaataacctgaaccgacatattctttaatgccacgtttttcggcattagtatattgaagaggggtacgggttctcgtaattgtttcaatagaagatgaaacattctttgcataaccttgaagagcagctttaatcattttagtacgttcgatattccaaagattataagccatttcttctttatctttctgctcaagatattgcggaactcgtgtcataatatgttccattgcttcatgtttacgttcttcaagtgtatcaagaagggtttgaacataagcctgcatactttcaacagatgttaaaggcgcattgccaatacggaattgaagatctttagtaaatctttcttcaaacttatcgcgttgagacaattttaccttaactaaactgctcaaataagtcgatgcaccggtagcagccaaactagcagaatgtaaacgagctgccttagagctaatagaatctttaatctgttgtgcttctgggatttccggtgcagtagcaggtttgctgaattctgcagcagaagcttcatattcttcaaatttctctgggtcgtgaataatttcagaagtcaatgattgacttgccgcaacctgacgacgagaaatcttagtacgagttacaacagccctgtcattacgtttttcttctacagcggcaatagaaccagcaatagcagtttctttagttacctgtacgccttctttcttgcttacatatacttcaccgacttcagaatcaacgcgagtgtaaaggtccgggttaataccaggcataccagcgatatcgtcaatccgagcgttcttacgaactaccaggacgtatgtatgcttgccggtaaattggaacatactcgggactactttaaaacgtccaccggtcttctgcataacaagacgagaaagaacacgttggacaataggaccttggcctttcattttcttagtagggaagcggaacataatcgcatccatacgcagctttttgacttgagcatatacggtatcaaagatggtattaacggcgttaataggttcagggccaagaccacctttaagttcagctggagttcctttagcagataagctcatcaagataacatgggcatatttatcgccaagcttaacttgtttaatagcatcgccttcggaaacataagaaaccatacgagctactaattgtgagtctacatcaccaattttccaaatttgtggtactttaagttttgggttcaagtttacaacaggcattgtgccttctgactcgaacacctcattgagttgttcagacataattattcctcttattagttgtctgtatttatgcccaaaaggagccctaaggctccttaccaaagtggtaataatgtacgatagacctcaaagcctggagctttttcgtgtgcatcaaacgtagcattaaaattttcccattgagttggattatcaaactcaagaataatctgggaacaagaggtggagatatctccaccttctttacgtgcaattacaactgtttcaagatatgctttcatagtcctgtctggtcccatgaaccaaatacatcttcaaatgtatctgcgcttgttttatcaaaacggaagcctttaataatcggaaggaaaatacctacagttccgtcacgacccttagagtgcacccaaccattacattcgcaatcggcaatgcgaccaactagattaccttctaaggcctctttcatcagtcgttcacgatctaaagcatcacgttcatcgattggaatatcaacccacttacccttgactttcacacgagtcgtatctttaaaaccagaaccacagtctgtggtaatcttaccacacagcgatttaagctcaacaccgccaagtttattagggtctttagagtgtggatagaaaccgacgatttccattgcaatgtcgataacttctttgaacttgataaggttcttagaacgtttgttttcccagaaggaacccatgttcttaagaataataccttctaagccttggtctacatatttcttatagacttcacgagcttctttaagactataaacccactggttttcaatcagaataactgaatcgaaaccatgaagagcaacgccttcagcaatcatagcttcaagagcacggaagcgaacgtcataagcaaagccgggtttttcaccttcagagtaaacaacatctaatggaacatagtcccatgcctgaagtttcattccagatgcttcaacctgtgaaattgtacccttcaatgatttgtttgccagcccatttgaagtagaacggtctacattctggaattcagccgccttactcaattcttcaggttcttcgaacataccgaacaggtcattatcggcctttggttcaaccttaggagcatgataaaccagttcgccatcaatcattacaccggaaggatgacgcttacgagcatcctcagtaataaccattaactcttctgcaagcttacgaagacctttatattcattacctgcacgtgagaagaacttaacaccgtcatcagttacttcagcgaaacaacgagcgccatcagccttaagctgggcgaatgcaggccatttgatgtgtttttcaattagcttttcatcatatgatgaagccaacatctgaggctgttctgggatacaattcttccagattttatttgcaatggtaggacctgtaccacattcaaggtcacgaagtaatacacgacgaataacttcggcatcaccttcagaagtctgagataatgcaatttcaagtttttcgatagccgcattaccggttataacccgtttagccagcttttcttcaagcatataaagcatgtcttcaagagtaagatggatttcatctttagctcttgtaccccattttttgatgccatagttgaagcgtttagaataagccataatgaatacgcgtttcagaagttcattacccttctcacgttccatgatagctttcttttcgttaatagaatcagtcgcagccaattcattcaggatatcaataatcatgttattccttaatagccatgtgtagttctattatacgctaattcttctaacatcaggccaagttgcttatgatacgtgtaaaaatgcctttctttttctttatggtctttatgatgaacataaatgaaaccttgtgaaacgcattcttcaaaaatttcttcgccccgagcttcacgaaaaaccggatacatgcgcaagaactgattcacgtgaccgaagtcacgtgtacgtatctgatcgccatcacgcattaaatgcataacaaacattacttaacttccccataataagcacgaagatcgcttggtttgatgttgcgatagctttctggttgatttttaattctatcgaatggaggccaaccggtctgccaggctttatgcgggctgagttgacgctcaatttcgttttgaattacttctagattttttgaaacttcttgacgtctggtttcaatagctacaatatcgtcccaatcagttactttagtacagtcatcagcgaacccatcacgctcacctcgaaccatccaataaacaggaacatcaagaatacgtttcgctgcctggcaatggtgtggaaggtcatcaacaaagaacttaagacgggaaccgtatttcagacggaccttagtcagaatgagttctttactttcattatgagcgcacatatggatgtcctggaacgcgccagggaacaatgcattcaaattgaattgtctattcagccgagcatcaatagagtcaccaagcgccgttacagctacaaaatcgtaggctttcttgagcttgttgatattacgcaaggcatccatataaggcgccagatagcgaataaaatcagagctattgtatttgttaatcagttgctcaccaagatgttcatcacaaccaaacaacttacctggtttaatgaacttatcatcctgaatcatttccaggatatgctcgagtggcagattatatttctgtgcgaaataaggcagcccagactgccatgacagaagtacgccatcaacatcagttgcaattacaggtctttcattttgggtcaaagatgtggtcatatttggtccaatcaatttcagattcataagagacaaaagctatagattgcccttgtcgtaaacgttctttaacgatatgcatagtaacacaactcccaggccattcgcgttcggagttggcgccaatcgtaataaggcttccgattggaagcccactattcaaaacactacttaaactgccaaccataaatcggcctcacgataaacatcttcattgccatctgcccaacgaacagcgtaccaaaaaccttcaacgtatttgttcggaggcagaaccataataacccagcctgggatagttcctgcacctgctttagatacagaatctccaggcatgaatttaggaccttcatcaatcgcaatcattcttcaacctctacccagtcaggaaacacgaagaaatctggagcatcaaccatatagcagactttattgtcttttacattacagcctaatacttcaatcatttcattgttcatcaggcaacgagcgagtttaggagctttacatttagaagtcataacgatcataatatttttctcagagtttagtgcatgaaataaggtctaaatcagaccagtaacctaccggatggagattttcaattttcttttcaatctcatgattgacatcttcccacggccatacgttgatagttgtttcaaattcatcttcgatatgaccgtctgaacgagggtggcgtgacaccacctcaaatttaagtagatattttgccattagatagtaaactcagttgatactacgtcccagattgcttcacgctgttcttcagttgttttctgaccaagaacatggcgaagataaagtttaaccagaagttgacgattgtcaccatgctatgatgggtgggtaacaaaatcacgagtacgaacttggtcatggaacccaactttaataacagaacctttgattgatacatccaaacaaggaccattttcgaaagagaagaatacataattgtcttcccaatacatatcgatttgagccacagttccattgttgtgtttccacagcagaattggagcttgacctgcatcatttacatatttacgttcaaagttggtaaagttcattttgttatcccagtttgctgattgagtgtacataataccacactcaatcagcgttgtaaactgttattcgaaagaaacttgagttacaaccttagccgttgtttctaaacggaaaatacttacaatagcctttgagctttcttcggcaagaacaaattttgcatgttcttttgcagcttgtaatgtgaaacgatgaggatttgaattagtcccgacaaaatacccagtagagccaccgtattcagtaggttctatgccagatacatggacaatgtattcctcgatgtcagggtccacttctgcgaacatgtcccattcgtctttatagaaccatgaggcagaccaatcgttctctttgaattgaggcagggcctctagacgagagattgcatcttcgtctttaaaacggatcgcatagacaccgtcagggtcaccatcttcaaatgaaactacttcaaacttgcgcccacgtaagtaggcaacaatttcgcggtttacagtcggtgcttgttcgataaaatcttgaacattcttttcttcgagttgataccatttattcagttccataatttcctcagaatgggttagatacgatagacggtgtagttttcagggtcatacgagacagagcacggataatgactacttcgtctttaggattatcgtgcaaccaacgagaagcgaacccttcggcttcttctttagtacaatgatgctgacgaataagataaccagcgtcaccgctagaaagaaccagacatgcataatctcggtctacttcagactcttcgatttcttctgggatttcttcaaagaacttgaattcttcatcgccgaaagagatgattggtccaccgccggtataacccattgtattcgggcgcataacgtcaagcgaggagccatttttaactgcaatttcactaatagaaccggtggatgttttatcggtaacaacgaagccatctttcatgaactttgaaaatctggcattttgacgagcacagtcctcaaaacccagacgagctttatcatctttaaagcgataccatttgttcagttgcatttcgaattccatactatattcctcaagttagggcccgaaggcccatttagttaggcaaaagtgttagttttagtccagttttccaggtcaataacacctttagctttaatcttttcaatcaagatgttagcacgagtacgaccattttcataccatacaacatcttcactgtacccagtttcatcatcctgataggtctcagaacgaatgtggccgtatacaatagtgttcaaagcatagatttcgccagtgaagaagttttcaacagtgatgtgccagcagaaatcatcagaagggccatcaggagtcatgcagtgaacaacatcaccttgatgtttgcttaccatccactgtaactcatttacagtttgtgctttataaccatcgtggtctttgcatttcactgtagcgttcagattgattttcattttattctccgtttgaatctttgttgttgattgagtgtatatcatatcacaatcctaggagaagtaaacaccgccatgaaaacaaaaatgggaaccactagggttcccatcaaattatactgctttcggcttaccaaaacgagaagcatcatcgcgaagaacagcacgtgcacgtcgcataatcttctcaactgtctgattgatacgagagttcgacccacgcttgtaaccagcgcgtttagaatcaccaacaactttttctactgctttctttgcttttgcttgtttagccattattaagtcttccattttggagaaatacatgagagtcgtaaagacctctcgcaagccctctagggtacgtttaaactcttatctgttgcacaccgttagcttaaagggtccgggtccgatttctcgaggataagatatacaccgatggatgtataggccttgaggcgtactcccgattagccatcgcctcggggtagcatgcacttgccgtttattttcaagttcgcactttagtagcgtatcactggaggttttgacttatttaacgtcgggatgacctacaaccatgacataattacttcagagtaactacgtaatgacgaactgctttacgagccgcactgcacagtggatatgcatatttcagtacgtcttgagctgcaagagtatcacgcagatttgcttgtactggattcagatgtttgaaaccagacagaactgaaaggatttctgcgcttacatcgattgaagcaccagagttgtcatgacctgcgttatatgctttgcgctgaagttccagagcggtttgaataatagacattttatttcctcaaaatgaggttaaagattggtagagccccatcaccctcatgggatggcgcatctctaccgtatagaagaactggtcatgtccttttgtaggtagttctccagctcttcataattttatttatacaggcaaggaattgctttgtaatgacacgttacaaacttctgtttaatttctttagcctgtttgagaccaagagcaacaagaggatgtggtacattagcaattttacctacaggaagtggagttaaatcacctacttcacaaaaacctgctggaacgtcaggaccaacagaataaacggtgcacagctcagggatttcaccttgggaccgtttaccaataatcaaaccagattcggtgacttcttcatcaccagcttgttttggttcagaaaccaagataacatattcgccaacggcacgaattggaagttccattttattaccattttgttgtagtggatgtaataatattatcacacccactttaaagcaaattacttacctacgaactgaagcaggtgctcaactttcataccattaactgagatcagtttatcgatagaaaagccacgccactgtttaatatcagtatcaaaggcaggaaccatatcagtagcttctttacgaggcttactaggatttacatagctttcataaatctcttcacccaccagatcagagataacctgtttgtcacgagaggctttcatagtacggatagtaccatcagccttttcaaagacaatgtcagaagtacccatagccagtttggttttcagcacttcacgaagtgcgattttttgttcaatagtcagtttcattattcaccacaaaaattacggatgttttcccagttcagagaacggagattattacgctgatactcgaccacttcaattcctgcttcaagcagaatatcagcccagttgtcaggtgaacggtcataacgctctgcgtaaacgactttcttaatacctgactgagaaatagctttagtacaatccgggcaaggagaagctgtgcaatacaatgtagcaccttcaatacttgaccctttacgtgcagcaaacagaatagcattcagttctgcatgaatttcatttttagcagaccattcactatgagccggacgatgctctttggctagaaccataggagctttagtttcccatgcttctcgtggtttcattttcagccaaccttgactttctgcatggtcacaacagtttgttccacctgcaggagaaccattataaccagtagaaataatacggccatctttttcaattactgcgcccactttccaggaacagcattttgactcttgtgaaatgagatatgcaatctgcaaatacgtggacgctttcatttaatcaacctttttattgatgtgagtcagaagttcttcagtttgttcccaactgatacaagcgtcagtgatagaaacaccataagccatattgtcagaaatcttttgatttccttcatgtagattagattctatcataataccttttacgaaggcgttatctgctacacaacgccccacatcaagctgatttatgtaagaacctgaagcgttagcatgactacaatcaaccattaaatatggattcaaactttgtgcagaagcattctgtaccgcgtctaaaatatgtgagctgtgatagttaggaccgtcactgccgccacgtaatacaatatgagtattaacattgccttttgcatgaacaatgcctacgcgcccatcctggtccattcccatataacgatgcgggaatgcagatgacaacattgcatcagtagcaaccttaacagaaccatttgtcccgttcttaaagcctacgcacatcggtagacctgaagcaatttcacggtgtgtctggctttcagttgtacgagcaccaattgcaacccaagagaaaataccggtcagatacttaatcgtgaacgggtctagaacttcggtggccagaggcagaccaagctctaacagattgacacataactcacgagcagtctcgaggccaagatgcatatcaaatgaaccatttaattcgggatcattaataagacctttccaacctacagtcgttctaggcttttcaaaataaacacgcataaccaaaagaagatttggatattgcgcttggattttggctaatctttttccatattcgagagcagctttagggtcatgaattgaacaagggcctacaacaataagtttgcgtgggtcggtgtcattcataatcgaatttacttgttcacgatgggcagcgacttgcttttcaagtgccgccgtcaaaggatatgtttcaaccaatgtttttggagaaattagtgattcgactactggtaacattattttgccttaaaatttataaacagagtgtgattcaacacggccatcacgacctagagttaaattgtaatactcttctttgtaagcaatcgtatcttttgtacccttttcaatagtaataagatacgatacaggactttcagcctgaacacggactttaacgtcattacgttgttcagagattttgttgattaatgcctgagcgaactcaggcacggcagctgcaaattcttcgatattaaattgcttatctgaaatcattagatgaaccctttagttgttgtgccgtagtcccaatcaaattctacccagacaatataaggatcttcagcattaagatgaacttcaatatacgatttgaaagaagtatgagtaatttctacacgctcaacaaaatcgccaaatagaatattcagaacgcctgttacttcagcatgaatttttgcttcagacggattgtcgagttttccacggacattattagccaaaacttggcgaaatacaacatcaacaacttcttgagttttagggaacattttgatttcctcaatggactgtgtgtacaactacgcgaacaacaaatgccactacagggtcgttgattggttggaactcaacatgatattcccctgcatagcgcgtatttaaatctttacgaatttctgcgatagcattaatcagaccagggttaaatggtctgccttgaagcttacgaagcattttatatgcttcttgttctacttcataatgtttatcgtacattttgttttcctcatttaaccggaagtctatagtatcataaacttccgggcttgtaaacagttaaaaatcgccgtggtcaacttgccaacattcgacaccgatgcgccgccacatctctacgacttgtgcacggtcatcaacagcaagtttgacatcataataaggagcaatatcacgccagaagatttcttctttaacaatcatgtcgccacgtgaatcgccatgttcacgctggaaatgttcggtaaatggaatgaatttatcagtaagccatttacgcgtcatcactttatatttgatttcgtcgtctttagtaccagattcacggccacttacaacgatgacagcgtacccatcacggaaataagaacgtgccaattcaaccaccattggattgatgatatcggtatcacatttctctagatcgtaaggagaacgacctaccattttagctaatgtaccgtcaacatcaaagataacagctttaggtttacctggagtaccgttgtaaactggcttgccttggtattcacagaacttccagaacatttgacgcagaacatcaattggcacagcaccttcaccgcgatgcaagttacgcttcagaagttcggtccacggtacatcaaatacttcttcgtgataagaccaaccttcaacaccagccagatttttaaaatcatcacggcgattttcattcaggttcgtatccgcgacaattacacctttagtagattctttggccataatagccataatctgcattttggcagtgtcagttacaatttgttcgcgagccttagaatatttgtattcattacgattcgtgatacccatcaggcctacacgaatattatcacggttgacaacataccaacctggacgagtcttgcaatactcttgagcccaagtacttttaccactacctggacagcctacagttacaataagttgtttcatacaccaagttcctcatataattcttcgcgacagatctttaagattttacctgtttcatatgcagcattttcatcaacatcgccaagagctgcagcggcctgcatttgaccgtggcgcttagctgcatattcgaagctacggaccaactcacgaacacgttctttctcttcatgttcttcaatgaattcaggataattacgaactgaagtcatcatacgataccaattttgaagtgtaatatagttcttttctttaaggttgataacacgtgacggtacatcagagcctggcgcataataagtaacctgagttactacatcttgtccatcgatacgagtccaagtgtaattgaaagtcgctttcttttcaagaggcgttttcatacatgaaccgattttgagaaggtctttgagctcttggtgtttgatgccatttgcatattcagcatgagctacgaagcagttgttacgtaaagtcataatattttcctcagttgagatatccgtggagggccgaagccctcaattacattgtaataacaatacctaaagatacagcacaagcaactccggctacaaaaaggccgatacagaacagtttagcacctaatgtcattttacgcattttgtttccttcagttcagttcgataataacatatcatatcatttgagtcatgtacataccggctgatgtcatccatccaagaccgatatttctgagagtcttcaaaactcatgccaacccaggccttaccatcaataacttttacttcccatttgctatcataagctttaatagggtctggccatgatgggtgcaatttttcaaccttagtgggctcagggagcttctgggcgcatcctaccgccaggagagataaacatacagccgcgacttttaaattcatttcgtcgcctcctggagactctgagcaaacttattgaagcttgcgttaatctgattttcaactaacccaggcttcttggccacaacatcagctcgctttgaatctttatcaagcttttggtcagatttaacctggtcttgacgacgttcactacgattcttatcaatgttctgaagacctttaaaatcttgttgcagagttttaatctgctctgcttgggcgttagctgtttgtgttaccgtattaaggtccgcttgaagcgactcaatacgtaagttctgaacaaataggcctgctccagctaatgctgcgataatgaccattgttccccagatatttacttgcataactttttgataacctctacgatatcgtcacgtgacaggccattcaccagaacatgcttagcagtttcagattgaactttatggctgttatcaatcagagcagcaacttcatcagaagtcagagtgctgtgagcgataccgagacgattaaatttgtcagtcagtgggtcgcaaataatatagaacttatgcccattgatatgaacgtttggctgactgatgttaacgaacacctcagcatcaggtaggttgttggacaagaactcgaccatattatcaaccgcctgtggcattgcttcacgacgctcttcagtttgcttagtactataagccttctgtttaactttctgagaaagcttgcggcctagcgtcaagcggagatcggtcaagaacccaattttcttagagcctttatagacataaattccgtcatgacggtcgccgaattcttctacaactgcttcattagtaatagcttgcaagttcatcgtgaatccccattttgttagtgtaggagcatcttaacacaataaaatggggatgtaaactactcgccgaaaataatttcttctttactatattctgcaggcacgtgcttcttgcagttcttcatgaagaccttaccgagctgctcagggagagcatcaaaatcgaggcctttctggaaagcattcatcaggatgctgaacagaccaggctgttctttaagttcaacttgtgctttcaacgcaaagtctttacggtccaggccaaccaatttgttgttcaggtcgacaatagtagaaagagatttgcccagccaagacagataaaccttttcaaatgcttcgactttattgaatgcatacgcatcaccagcgaacatagatttcagatcatcagaagcattagctacgatagaaccgaataaacgttcattgttgttgattgaatctttagtgtggtgtaatgcacagtaccattcggttttaagcttaaacttcaggccatcttccatttcaaagataaaaccttcaatgccttccatcttacggatttcatttacgaaatcaggattgctggtatcaatatcaaagccacgaactaagtattgacgaagaataccgtctttgaacagttctttatacggcacatattcgccggtatcattatgacgaacgttcagaagaactaaagctttttcttgatagtcaagaacaatacgattatctggtgcaacatactctaagttagcagtataaccatctttagccagctctaagaggcgctcacggaaagcatcattctcagaacgataaatccactgcagtgctgcatcagattggtcagagtaaatagagcctttagatttgacacgcaggcgcccagcatcgacaaatgtagaaatcagagacccatcttctttagccgttaccaaagaaaccttgctgaaatccaggttcatagtaaatggagtttcattcagattaaagaatttttccataggacgagaagcaatacgaacaggaccattctcatcgatttcaaacataatgccacggcattctaatgcatcatcaaggcaccaatcggtgtaagaagcaaagttgtaactaaaaattctaaattgggtaccgaaaggagaagtgaagtccttatagaaaaacttcattttatcacaagtctggcacaattccattaagttgtcgaataattctttcatcatttagccttatgttgggtgttccatggaggattgaagagcttgatgaatagcggttcttctaaatccatagtagctacggacatcgtgccaagctcatttgtcattgatagattaaaacactgacgtgcataaaactctaccttcttaccagatattaacgcgtcgtatatagcagcagatttgattgaatcactgttttgatttgtgcgattaatactggttctgtaataatttatacgtttgcgcaagttcttagtcttgcctatgtacatcagttcatcatcgactgaaatagcatatatgacgttttgcttattcggtaccgtaagagtcttgatagtgcaatcgtcgttgagctctaatgtaacatactttatgaagctgtattcatttgctaatttcatactaaagtagggccaaagccctatccttaaagataaacacggaagccgttcagtacatccgcatcgacatcgttatcaatttgtgcaacaagataagaagagatttctacttcttgaggcgcagcctgtacaaggtctgagttcagatattcacgaatccaagggataggatgtcgtgttgactcaagtacaatatcacaaggaaggccagcagctttcattctgcttacagtcagataatcgatgaactggtgaagaatttcaacgttaagacctggaagaccaccattacggaacaggtgaatagcccattctttttcttgacggtttacttccatgaagatttctactgcttcacgttcgcattctttagcaatttgaacccactcatcgccatcagtacccatctggagttgacggatgatatattgagtagatttaagatgaagctgttcatcgcgtgcaatgaacttcataatcttgctgttaccttccatgatttccatgttcttatggaagttgaaggtacaagcgaatgaaacgtagaaacgaattgcttccagagcgttgatagaatgcaggcacagataaagagccttcatcaggtcatgcttacacccggcttcatgttcaacagcatctaaaaacagctcatcagaatgttcagacgcttcataaaaatcaacatctgctttagcattctgccaatgacgagttttttccagaacatcatcatataaacgaccgatagattctgcacgagccataatagcttcatcaagaataatctcatcgaagattttagcagggtctgcgaacaagttacgcatgatatgtgtataagagcgactatggatggtctcagagaacgtccaagtagcaacccatgtatctaatgccgggtctgaaattaatgccatcaggaccgctgaaggggctctgccttgaatagaatcaagcagtgattgatacttcaagttagaaatgaagatgtcttgctgatggtccgcaagcttgtcaaactgagctttgtcagtcatcaagtttacttcttcagggcgccagaaaaatgaaagctgcttttcagtgagctcttcgaattgtttatggcgttggatatcataacgagcaataccaaggctcgaaccgaagaacattggttcattcatgatatcaacttgctctttattaaaaactgtactcattatttacccaccgtataaattgctttcataactttttctcgactagaaatagggtatgatgccttttccatttcaaaatctaattttgtaacaatgtcgatatatgaggccataagcctttggatgcattcatcggtttctttcataagagctacttcagcctgttttgccgatgggatcagtctataatgtgattctattgaatttatataatttttaagtgggccatttttgaatttagttgattcaaaaagttttaaagcaaattcggctttgtcgtgttgtctgaataaatcaatcatagggtatacatcctgttcattaattctggtgtaggtctcatagctgcctgttgtcgacaaaattcttcgtctaacttcttaagctctgatataattcgttctttgttttcatcagtaattttaaaattctgagaaaaatcaattaaatcttggattgtcataataactccaaaggctcatccatgagccaattatattacaatttacaagcagtgcaatcgtcagctttaggaccttcgatttcataatcatcggtaccagaaccatcacgagtgttgtgataataagcagtcttaccaccgagtgaccagaagtaaagcatatcacgcatcatgactgacatctcaaccttacctttagggaagttctgagggtcataactgaagtttgtagaaatgctttgacatacgaatttctgcataattgcagcctgagtcaggtaaccacgcataccacgtttagtcatctgccacagataatcataaagctcaaggttatcttcaaccttcggaactacttggttaaatgaaccttctttagattctttaacacttacgggtccacgtgggggctcaatcccattcgtagagttcgatacttgactgcttgattcacaaggcatgagagctgacaaagtggagttacggataccgtgtaatttaaggtcttctcgcaactgttcccagtcgcatacatagttcggcgctgcgacgttgtcaatctttttattgtaccagtcgataggtaattcgcctcgagaccaacgagtgtctgaataatattcgcaatggcctttttcttttgcgagcttaacagatgctgtgataagtccatattgtaacctttcaaacaattcatgagttaaatcgttagcatcatcatatgtagcgaagttattagccaagaacccagcatagtttgttacaccaacacctaatgcacgacgctttttagctttcagcgcttcttcaaccggataatcctgataatcaagcaggttgtcaagagcacgtaccattacttcagagagttcgtttaccatgtcatggtcttgataatcaaaactatccagaacaaatgccgctagcgtacacagagcgatctcagggtcatcaccgccaacatctttagtaggtagagcgatttcgcaacacaagttactttgttttaccgtggcaatgtcacgaataaatggaccatggtcaccaacgttatcaacgaaataaggataaattcgtgctgtaccagaacgttcagtgaagaatgtttcgaacagctcgagagccttaatacgtttcttacgaacggtagggtctttttctaattgttcgtataattcacggaactcgtcggcatttttaaaataactttcatacagagcaccagccataatttcaggactgaacaatgtgatgtaatcatttttaatcagacgttcgatcatcaagtcgttaatctgaataccatagtctaagtgacgaatacggttttcatctacgcctttgttgtttttgagaaccaaaaggttttcgacttcaagatgccaaatagggtaataaagagtcgcggcaccaccacgaactccgccttgggaacaggatttaactgcagtttggaagtgcttccaaaatgggataacgccggtatgtttgacttcaccatgaccaatctttgaaccttctgcacgaatcatgcctgcgttaataccgataccggcacgcttgctgatatatttgatgatgctgttagccgctttgttaattgaattcagtgaatcaccgccttcaataacaacacaactactaaactgacgagtaggagtacgaacacctgccataataggagttggcaatgaaatctgacgttgacttaccgcgtcgtaaaaacgaagaacatgcttaatacgttcgtttggttcgtcctggtgcaagcacataccaatcaacatgaatgcgaactgaggtgtttcgtacactttaccagttgaacgatttttgaccaggtatttttctttcagctgcatcgttccggcataagtgagttcgaagtcacggttgtggtcgatacgagattcaagatatgcaatttcttcggctgaccatttctgaaggatttctttatcataaagaccttcattgacaacacgagaaatatggtcaataaatgacggtggttcgaattgcccgtacacgtccttacgtaacgcgaacatagccagattagaagcaacatactggaaatcaggctcctgaacagagatggcatttgctgctactttgataatagcagtttggatatcacgagtggtcataccgtcttgcagatatggtttcacacgttcatataaatcgtatgggtcgatgttagtattttttgtagcccaatccagaacttggatgattttatttggttcaaacagcgttgcaataccgctggactttactacttgcattataagtcctctaatgaaaatgtgtctttaaaaagtttattcaccacttcagctattatatcaccatgacacggcttaggtttacatgtgcatcctaatctcattccacgcaatggttctagatgggctctagtgatttctccgtttcggagtttattataaaaatcctgtttaaatgcaagaatggcagcctcacgactgccagcatctttacctgcataattaccccagaacgttcctcgatgaatattaacatcgaagtcggactggtatttattcacaacccgacacgctcttttcattatacggccatcttcgctttaatagtagggtggctttcgtaaccaacgagtttgaagtctttatgagtcataacttcagttacatgcttcaactgtccttcagttgttacgccaggagcgttaaagttttcaggccaattaatttcaagctggcacagtttcttaggctcacgtcgcagaacttcttgacactgttcgatatggttgctatagatgtgcgtattgccgcctgagaacacgaggtcgcctggaataagattacacatcttcgctacgatatgcaacagggcggcgtaggaggcgatattaaatggtaatcctaagaacacatccactgaacgctgataccattgtaggtcaagatgaccattacgcacgttgaactgatagaacatatgacaaggaggcaaagccatacggtcaatttcagcagggttccacgcagaaacaatctgacgacggtcattaggcagagctttaatacgatcgatgattttgactacctggtccacgccaccaaaatcgcgccattgtttgccatacactgggcccagttcgccaccagaatagccaagatctttcgcctggttttcatagttttcgtcccaaatagttttaccttcgattaatgaaccatgagtacgccaacgcagttcattaacatttgtgcttccagacaagaaccatagcaattcagcaatacaagccttccatgctaatttcttagtcgttacagcagggaatccttgagtaaggtcccaacgggccttcgtcccgaatactgcaattgttccagttccggtacggtcatcagtttcataaccggttgtaagaatatgttgaatcagttcttgatattgtttcacaggctcatccaatggtctttaatataaatttcgtatttaggtttatacccaagcttaatcatttcttttgctttacgggtaaacccgagtgaacgttcacctttacgctgctgtttttccgtcatactgccttgatgaatctgacgacaaatatataacgacattgcatcaggcacaccattaactttcagtttattgctcattctgcacctaatataaagagaatttcactgccacgtttatcgaatctacctctcatagatacgatatcttcattataccataaattctgtgcagcaatttgtttcaacaattcaacatgactgcaaagaactttaacagtacgaccttgagactgtccgtatccatctagccaaagacggaagccattgtcatggctttgaatatgtttaatgtcgcaatcgatttcatataggccgtgaggaatagtattgaacaaatgaggattacgtttgtacccatcaatagtcgggactggcccttgaactactaaagcccatttcttttggactgggtctacatcaataaggcgaatcataatgaacctctgtttcaggaatgaagtagaacttagtgccttgtttttcgaaatgaccaataatagtcacatacgggtcgtcgaacgtgatattaccttcacgcatggcttcaatccatgttttcgtgcaacgagtcagatgagttgtgaactgcttaaatgggccaaactcaccatgaatatagttagcgtttgtagagaacaggctaactttaatatccgccagaggcagatgaagagcatagattcctttatcgaactgaggaccctgccatttaggttgtttctggaacttttcgattagataggcttgatacataattccctcggcttataaactgattcaacgatttgggtaatttcatcacactgaaaccagtgggtttcagtcactttatactgcgcacgaagattaaacattgtttcttcgctcatctggatatcagaattaacacgatggtctttaatgatgctagtatgtacgacctggtcaaccctggtaatcgcctgctcaattaaacctttaccgccaatgatacttacattgtcagtgttccggttcactacggtgtcccagggatattccttggtggccgtagaaacaatgatattctcgccattcaagaagcgttcgaactcatcagggctcatgacttcagatggataagtaccatctttagtttgaggcttaccacgttgtaggttgcataccacaatcgaacgacgtccaggaagaggctttggaaaactctcccatgttttagcacccataatcataatcgtattatcggtacgtgctttaaagtttttcaggtcttgagggatacgcccccacggcagaccattattcagaccaaaagcaatttcattacgaccatcgacagtctttgtattacaagttgcgaatactaattggagcattatcgtacctcgatataagctacagcagaaggagcaacatacatacccatttcgtcacaagggtcaccaagaacaaagcgataattgttaccgcggccttggaaccaggctagttggactgtgtgcatttcgccataaattgtttcaattaagaaaggcttatcatatgctatgtttgaataaagcgtatccaaacagaattccggtccaattttgaccagcttgatgtctttgtattcgagttccattaaccctgcctcatcccacatttaaaacatttaccgccaagactccatagcccagcgccgcaatacttacattcccagtcacttagaatccacatgatttgtagccactcgctttaaccatatcacgaagaactttgaagccttgttcgacagcgccagccacttcttcaaagactgatttcttcagaataaaaagtggaccactggctgttttattgccaatgcaattgttgattacctggacatccagagggaagtcaccataagcggtttcaaccttaccaaccacttgattaccacgtgaatgtgggtcaaatgccatatggatgtttgatactccaggaatagtatcaaactggcaacgaactttaatcgtcgggtaacctgttacatgaatatcagccatttttcttcgcctttttccaagctgctttaaattcttcaacgtcttcaacgtgaatccagaatcctgaaccgaagccatcttcatagcaagggcaaccatcacagtaacggtcccaagtaactacttcagaaccgatagtatgattgcattcgattgcacgaagacgatcttcagcagcttcaagagcttcaggattatcatcatgaatatagaacaaccacttaccacgattttcagaaccaagtttaatgctttcacgttgaagtttcattttaatctccttgttggtgtagaagcataataacatgcctctacaccgatgtaaactatttctttaaagcttctttaaaaacttcaagagatacagtatcagccggggtcagatacacataattgaatacacgaccgtcaagcccaaagacttctacacacagattgtagtagtcgctttcaaccaaatgcatagccttaggctcatgaattcggtcaaatagctgaacaacatttgtaccagcccagatgttgttacgaccatcataatcaaaatcttcaatcagaacataaatcattttgcctccagagtcataatttctttgaagtagttagcgtgcagctcacgattggcttcaaagaagaagtcatcattgaaatcaatcagagaatcaaaatcgccttccagaaccatcagggtgcatacactaatcagtttttctgatacgatttttactttagatttagcagcgatttcacgagccagttcaacattcttaactacaacttccagttttaaagttttcattttatttctccgtttgtttcaatttgttggtgtaggagtatagtaacatgctcctacaccggtgtaaactacttgttgaaaacttttttgattaattcaatcatttcttcagcgttattagaatctacttctaatttcatctcaagaacaccacgtgaagcaccttcaggcttgacttcttcaaagaattcaaattctgagctacagatttcgaagtaagtgtcgccatcgccatcctcgccaaacacttcaccgtttgacatgcggactttagttacataacgatcagtaccttcgctatgaaccgttaaaactgtaaacgaaccaccgttctcatcgatagattcgagcatattttcgttgcatgtattttcatcaacaaactgttcacgtttgctagggataatgcggtatactttgccttctttcattttcaatcctcgatgctttcaagagtttcggctttaagttcttcgtccatacccaccatatactcattatggaggtaatgttcgataacggaacgttcgccttctagtgtcacttcacaacctatgccttctttacaagaaatttctttaaggttataacgatcaagacaagtctcttggaagtaagcataatcataaacgtagatagtaactttagccatttttaaatctccagtttgttggtgtatgagtatagtaacctgttttgaaagcgttgtaaacacctttgttcaaaaacccctaatggaacatataagttactttatccgcaaaaagtggacttaacgtaacttatatgttccataaacaaaaaatgggaaccgttatggttcccattcattattacagaccagctaacaggtcatcaagaccgtcgtcatcaccaccggcttgaacaccagtatcgactgaatcttgtttctgaggtttagactcgaactgtttcatttcttcatcaaaaccgtccagttcatcagcacgctgttcagctttagcggctgcagctgctgcaccaccacccagagcggcagtacccattactttagcaaatttcttctggttgtcttcgaaagacttaaatttagccagctcttgcaggtcacccatgtcgtccatcaatttcttctgaacagcttcgtcatcgatacctggaatttctgactggttcaggaatttggagtcatcgtagtttttgaaaccaccgaccattttgcatttcagtgcgaagttagcaccttcatagacacaagtcacgtcaatcggagtttcaccaatttcagtatcgacttcaaccatctggttaattttgtccatgattttctgaccgaaacggtatttgaatactttaccttcgttagcaggaacagccgggtctttaacaaccagaatgttagcccagaaagaagttttacgtttcagcagtttgtattcttcaggattactattgaatgaatcgttcttagtcaagtgttggcacactgggcaagaatcgaaatcaccgtgagtagaagtacagttttcaatgtaccactgaccatttttcttaaagccatgatttaccagcttcaggaatggagatggattttcttcattcttagaaggcaggaagcgaattactgcggaaccaacaccatcagtatctttcagtttccactcatttttgtcgtcatcataggagcctttaccacctttcattgcagacagttgagcttggagttgtgcagggtctttacgcttaaacatatattattaccttatttacagttatttagaatttacagtttttaacagtttcaatgaacagctttcgtgcttcggcagagtcaattataagaattttcttataggcatttaactttgtcgagtatttagaccagactaaatcatttgtttggtcatcgtgtttatctattatatccaagaaggagtcaagcaaaataaacgtttcgaatgaaatcacattcgattggaggagtttaaagatatagctcgattgaactttattattatactcaaatatttctgacagcgcttttacttcaaccttttggctaaagtaatagatgtttttgatgtcatctttaaattgttcttttatacgttttaatcgaccaatatattcacggtagaaaacgagggcgtcagcatcactgatgtcgccaatccatgcatcttggttagctaccaagttagacatgaaaatgagcgtgagctctttcaaagtgtatttatcacttaatttttcgaagaaatatttgtcacgtcgtttttgatacgcagcatcagagactcgcataacccaattgtacttaacaacatcgtagcgcccattaaagtgctgtttgatggctaagtacaaagtgtagacactcttgccattgaccatgcgattgttgttagcgggcatgcgaattttaatcataacaagaagtccagcgtatttgttttctgagtacgactaaatgaaggacgaagcatatggtcatcaatggcttcgtttttaattttatcaattataccctgtgggatgtatttagcaaacaacccttctggtattgaattttcttcaaggaataaagttgtcgcttcaagatagcctaattcacccttggcgacgatagcttcaatagcgaacgcattttgttgtttatctaaacaaacatcaagcgattcaacaggggcttgtacagccccatcaaaatcagttgtcgaagactgcgtcatataattccaccacttcggttttttcatcttcaaaacgttcacgagtgcctttatgatacagggcaaacagctgattgaactttttactatctacaccaagttcatctttagctttagtacgaagttcagcgacttcacccatatagccttcggctttcagtttagcatctgatgcggatttaaccagtttggcgagctcttcgccatgagtatcaggacaaaattcaactttcacttttttagcttctttagccattatattcaccttaatagaagtcctgcacgtgggcagttaatttagaaagaccagacttaacaaagtaaggatatacttttgatttagccggcacctgataattattataacgttccatgattaaagcaacaatatcatctggaatagaatccatatcaatgaggagttggttttctttgaaacgtttaaactgttcttcagtcagaagtttttccatcgcttcgtcatcataataattcaaagcgaaggtgtcaagttcttttgctgtcgtagatggagtacgttcgccatcaatacgagtcaaccagaaattaccacgaactttaatgcttgcgacgttatctttcttatcgcctttaattactttagtaacacaatccatgagggcatcaccagatttagtcttaacccatttcttctgcataggagaccactgtttaacaccaggatatttgtgaagctgtgtaaagtcgccgtctgacgaaacgattacacatggatgtcctaaagatgtaagatgtttgataagcacagcgatatggtcatccgcttcaaccttatcaatattcattacaatataaggcatatatttttcaagttcttcaataatgatatgcattgcattgaagaggccttcccagtcgaacggtgaatcttcacgatcaactttacggtttttcttataataagaagaataatcacgacgccaataaccagatttactgttatcaacgcaaaccacaagattttgatagccttgtttcttgaagtcttttttgtttttcttgagtgaattcagaaccagatgacgaagcatcgcagtggtcactcgaggatattttgcagcttcgccgaattcagtaaaggcagctgccatgataatctggctgaagtctaggaaggcgaatccttccttttcacgttcgtcttcagggagtaaaaaatctaattcatttaaagccatatgaacctctgttcagtttagtttagtttactcgtctatagtaacacatccatgggcagcaataaatagaattattacatcaaatgataaaggaaacactatggccgatttactgaaacctgcattccgtgccacatctggtctcgatgctgcgggtgaaaaagttatcaacgtagccaaggccgacttcaatgtacttgatgacggcgtgaacgttgaattcttcattgaagaaaacacaatccaacagtatgaccctacgcgcgggtataagaaaaatttcgctgttatctatgacaaccgtatctggacttctacgagagaaattccaaagcctgcaggagctttcgtagaacagtattggaaagctgttcgtactgaccctaaatgggtagaaatcgtccagccaactcattcccttaaatcaggtgaatacgttactattaacagtgatgaccgtgcgtgcacgttatctttaccatcaaacccacaagatggtgatacgattgtaattaaagatatcggtactaatgctggttatcttgagcagaaaattcgtgctactaatcaatatatcgttcgtaatggcgttcaggttcaagaaactattttaaccaaacgcaattcatacaatatcctgatttattcagaacgtttatggcagatgtatgaaactgcaaatgaagaaaaggccatcagaattgtacctggttctcctgttcgtattcttgcaggtgatttaattgctcgtagatatcctactgcaggtgcagttcaattaattcttcctaagtttgcgaatgacggcgatttcatcagaactgttgacgttgatggaatgggttctgtataccatttaataattagcacttttgataacacatcatcaattggcaaagccggtacgacctccatggaattccgtacttcaggccatggtatgctaatttattctgcagccgacaaattgtggcgtgtttgggacgctgatttacgaacccgtcttcgtattatcagagacaacgttaaacttctgcctaatgaatcagttattgtctttggcgaaaataacagtaacgtccagactattactcttgatatgcctacagacgtagctatcggtgatactgttaagattgcactgaattatcttcgtaaaaaccagacagcagtcattcgtgttgcacaaggttctactgataagattttaactgatattaagctgctccagttccctaaacgttcagagtatccgcctgatgcgacttgggtttctgtatcttcattgactttcaatggtgatatcagttatactccggtaattgaattcagctataccgaagataatggtgtaggtgtttgggttattgcccagaacgttcctactgtagaacgtgttgacccattaaatgatgcgactcgtaaacgtcttggtgtaattgctctggcaagccaggctgaagccaacgttgatagagaaaacaaccctgttaaagaacaggcaattactcctgaaactttagctaaccgtattgctactgaagcacgtcgtggtattgctcgtattgccaccacagcacaagtcaatcagattactgaatttgcgttccaagacgacctcattatttctcctaagaaattaaatgagaaacaagctaccgaaacaatgcgtggtcttgctgaaatcgcaactcaggttgaaactgatgctggtacagatgatgcacgtatcgttactcctaaaaagcttaatgatcgtaaagcaactgaatcattaactggtattgctaaacttgtttctactgtaggtactgcaaaaggttcttctagagccgtaatgggaaccaacgtttacaataaaaacaataatactgatattgttactcctaaatctttaaatcagttgaaaggtgaatatgaagaccaaggtctgttctattctgctactgaagctgaagttatttctgggacagtaactgcaggatttgaaaacgttgctgtaacgcctattgaattgcataagaaaactgctactgaaggaaggattggtttctctgaaattgctacgcaagtcgagaccgatgctggtactgatgatttccgtttcattactcctaaaaagcttaatgatcgtaaagcaacacaaactcttaccggtattgctcgtattgcaactcaaacagaatttgatgctggtacgttagataatgttatttcaactccgttgaaaattaaaactagatttaatgatactgctagaacatctgttatcccggccagtggtttagtagaaacagggaccttatgggaccattatacacttgatatcaaggaagcaagtgagacccaacgtggtacactgaaattagcaacccaggtgttaactgatgccggtgtagacgatacaactgctgtaaccccactgaaacttcagaagaaaaaagcgactgaaagtaccgaaggtattattcaaattgctactcaggttgaaactgttgccggcaccgtaggcaataaagctgtagttcctgttcatctgaaatatgtggtccagcaagaaaaatcttgggaagcaactcctttacgtcgtggctttgttaaaatgactgaaggtcctttaacttgggccggtgataatgttaaaggttctgttgacaaccaagcaacgttcttgaaagatggttatgctgtttctccatatgaaatgaacttggctctgtctcattatctcccaatcagcgctaaggctgttgattcggataaattggacggcctggattcactccagttcattcgtcgtgatgtagaccaaaccattaatggtgttatgaccttcaagaaggacgtaatcctggaagcccctctgctctctacaagcactgcagattttgctggtactttagaagctaatggactaacctctactaatggtgatttcgctattgtaaacggaactaacaaatggaaattcactgctgggttaaatggaactacattagtaattggtgatacgactaacgtcttgaccatgaatacagcctccggaaacgtagctgtgttgaataacgtttctgctggtaataatgtttccgctaagacttcttatattctgaatagccgtgaagttattacaagcaatgcttctaacgtagttattggtgatgcaactaatggtatgtctttacgttctaaagatgcaggtaatatcattgcagtcgatgatactccattaggaagccaataccgtgtcttgactgaaaagaacgttaaagaaattgttgaccgcgatttcgttaagaaatctggtgatactatgggtggtaaattaactgttgaagctccagttctcccacagatttctgaagctaaagctatggccccattaaccgttgatacagtaggtttctggatggctaatattactactccatcggtataccaacagttaccaggttatgctattcctgaatttgctactaacgaccaaggtaacccttacgttgattcttatacgtataagcctgctcctggtctgatgacttgttctggtgtttcaattgacaatatctatcgtacttggactcctcgcccggttggtgttgctgataacgaaaacgctcttactcagtacatcagtatttgggacgttgctcgtggtgtatggggtgaatggtctcgtgtgttaacttctcagttaccaccaactccatcagaaattggtgctgttgcttcttcaggttcagcgttcaacaacttgagaattcgtgattggctgcaaattggtaacgttcgtatagagccagaccaagcaacgcagaccgttaaattcacttggattccataagaggtaatatggaaaaatatatggctggctttggacagggatttgtccaagccactattctatctgaaaataatgcggtgaaataccgcattagtgcttctggaagttgcactaaaagtacagtccgtccttacataaaagtccaggaccagcctatttctatattagtgcgtcctggacttaatgtttacattttcaatacaactactttagctattgaagaaaccaaaaactatatgtttacaaaggaagcgtcttctagtaacgaagccttcgtaacatatatggattctcttccggccggcaagctagctataatgttgtctgaaggaaagcttaatactgatgatactttggtttcatggttcaaatctaaaaattctacggcatggccttctaaatttgatgttactaattttgatgctgcttatacggcgttctatgcgacgtctaaggcaagtatcacgtcagagcatgtaatattcaacgatggggttaaaaatgaacctatagagcccctgattgatgtagtgtatgattattactctgacataggagccactgggtttcctaagaggatatttgaatttgccgaagaagcaaggccaactgaaaccgggctggcaataattaggcttcctactacagacttgcagacaccattatcggattataatcttaaaagtggtgatgtggtttactttaaattgcaacttcttatagatacgactgacccgtcaggaatcccaaccggaactactcgagcatcagttagattttttaatgaaaccactttagttagcgatacaactatagaagccaacatattaaatttaggcgaatggcaattattcgaaagggatataactattccggaaggagccacaggctttacagtatatgtgtctcgtcagagtacaaatgacattgctgctgccagaaatttagttatgactgaaacttctagataccgttatcctttgatgcgtgcatcggaatttggtgtcaatggtattagaaacaacgtattgatggaagatgttccaaacgatgagcttcttattcttaagaatacggatgctgatgaccgtggcattgtccgaagtgcagagtttcgtgaggtataagggcttcggcccttttttggtataaatacggctatactttaaggagaatactatggccgatttaaaagctggcactactataggtggagcgattgcctggcaccaaggcaacttccctctaaaggcggttacagatgacgtctattacaaagactacaaaatttatacgacttacaataaacctcaggctatagataacgatttcgtttctaaagctcaaggtggtgcttatttaaaacctgtcgactttatcgaaggattaaatatacttgatagcactggatataaaataaaattcggaataaacaatgctggctcaacgcctatgcatgcttattccgcttctattagaattaaagattcacttgcaatcgaaactgattcaggccaaccatttattttatttgaccctagtactgatatggcaaaagccagattaacagtaatggggaatattttagcaagatatattaatgacgagagtggacgcgtattctctccagggaaccctcctactccaactgatgtatcacttggtaatgtcacgaacgacgcccaggttaaggtagccttcacaggattacaaactatggcaggtcctttggcttcacctaatttaatttcattgaacccggcttctttgccagaacatgtacctcgtctttctcaggttattgttaagggtacaattatcgactttggaactttctaagaaggtcatatggcagatttaaaacaaatacaatttaagcgttctaaaacagcaggcgccagaccaacaacagctcaaatcgctgaaggcgaacttgctattaaccttaaagatcgcacattttttactagcgatggtactcaaattatagatcttggtcttgctaaaggcggcctgattgatggtaatattactcagaccggtaattacacccagactggtaatttcagcactactggcgatattagtgctaaaactgttttagcctcagcaggtgtttcatcaaatggtgatattgttgctgaaaggggtgtaattcgaactcgtgctgctgcttcaggcaacgctcatttatggtttgaaggtgaagaagtaactggcgaaaaccgtaataaagaacgaggtgttttatatgctacccaacaaacagatacaggtgggctagtaaaccttcgagtttacaatggtaaagcccacgcggctaatacaaacaacgcactgtttatgtttaacggtgccggggatttcaccgctcctaaagatttgtatggtcaacgctctcgtctgagcatcgaatccgttgctcctacgtttaatggcggacgtctttatactcgtgatcgaacttggaaccaatttggtactaatgattcatatggctggaatgaccttgtgggttatacagtaggccagaatggtgctttagcactgaactatgtatacaaaggtcgtgcccacgccactgcgacgatttggcatcatttaatagatgaaagaaccggcgcagaaaactcttggtacacaggttctggccctgaaaataaaatgtattctttagcaagccgtggtgctaaaggccatggtttttatagcggctctctgatggtcggtgctaacaattttggagaatattcaggattaggcgattcttctattgctttaggtgacaatgacaccggttttaaatggaataaagacggtgatattagcattatgtcaaataaccagagaatagttgacatatattcttcagctagtaagccgttttatattaaaaagagtactaaaatagtacatagtgataataactcggataacttgttccctcctaataataatgcgttattagaagttgacacttcattagacggaaataatgctggtggtaatggcgtaactcttattgggcacaactctggaagtaggtattatcattatttccgcggccgcggaagtgcaaattttgatatggataatggtgtatacataactaaaggcggattgtcagttactggcaatatatcatctactggtcaggttcagccttctaactttagtaacttcgattcacgttatcagaatttgttacaactcggcgccaacgtgaacttagatacgttagctgggctggcagaagccggtgaatatgcccagcactctaatgtaaacacatctttggctttgaactatcctgaagcactcgcaggtcatttaacagttacttctggtgcgggtgttcaacaaagatatcatgtttataatagcacccgtgtgtatttacgtgcgaaatatagttctgactcatggcgtccatgggaccgggtagtaacagaagattatttaaaaactggaattcctgcgcagtttgtatctaaaaactctgatggtttccgtattgcatatggtagctacgggttctttatccgtaacgatggtggcaatacttatttcatgttgaccaactctggcgaccaaatgggtacttggaacaatcttcgcccgttaattataaacaactcgacaggccaagttactattgatactccattaattgtatctcattattctggacttacagtaaatagcacggcgggtgatgctatttcatggggtaatgcaggtgctatttactgtaagtccagaataatgagatacaatcttygsmkrwygartwgtttmtaattaacgggcgaagattgttccaagtacccatttggtcgccagagttggtcaacatgaaataagtattgccaccatcgttacggataaagaacccgtagctaccatatgcaatacggaaaccatcagagtttttagatacaaactgcgcaggaattccagtttttaaataatcttctgttactacccggtcccatggacgccatgagtcagaactatatttcgcacgtaaatacacacgattcccggacgawayrwratatctttgttgaacacccgcaccagaagtaactgttaaatgacctgcgagtgcttcaggaagttgcactaaaagtacagtccgtccttacataaaagtccaggaccagcctatttctatattagtgcgtcctggacttaatgtttacattttcaatacaactactttagctattgaagaaaccaaaaactatatgtttacaaaggaagcgtcttctagtaacgaagccttcgtaacatatatggattctcttccggccggcaagctagctataatgttgtcttgatcgttataaccttaaagaaatttcttgtaaagaaggcataggttgtgaagtgacactagaaggcgaacgttccgttatcgaacattacctccataatgagtatatggtgggtatggacgaagaacttaaagccgaaactcttgaaagcatcgaggattgaaaatgaaagaaggcaaagtataccgcattatccctagcaaacgtgaacagtttgttgatgaaaatacatgcaacgaaaatatgcatgtatttt

SEQ ID NO: 4 - DNA, 48301 bp, Unknown
  bacteriophage genomic DNA
atgaatacattagcatgggaggagatgacgccagccgaaaagctggcagttaaggcgctatccactcacagcttcgaggcattccttcgcgtatggttccagttatcgcagggtgagagatacatccctaactggcatcataaatacctttgccgaatcattgacgaggttattagtggggagcgcagggataccatcattaacgtagctcctggggccggtaaaaccgagattacatctattcactttccggtctactcaatgatcaggctaccaaaggttaggaaccttagcttgtcattctcagacagtctggtgaagcgtaactccaagcgtgttcgcgacctaatcaagtcccctgagttccaggaactatggccttgcaagtttggcacgtgcaaggatgatgaaattcaggttcttgatgagagtggaaaggttagattcgaagctatatcgaaagcaattggcggtcagattactggtgcaaggggtggatacattacagatagctacagcggctgcttgatgctggatgaccccgacaaaccagacgacatgctcagcaaggtaaggcgtgaggctgtgcacgttttactcaagaataccatccgctcacgtagggctagtagcgttaaaggtaaagctacgccgattctgtcaattcagcaaaggcttcatacgcaggattcaacgtggttcatgacttctggcggtatgggtatcgactttgatgtagtgaagataccagcgctggttaatgaagactatgtgaacgagcttcctgactggattcgtgagcagttcgagaaggacgtgctttcatctgaatcagttgagcgtgatggggtcaggtactatagctatttccctcaaaaggaatccgtgcatgatttgatggcaatgtgggaatcagacccgtacacattcctaagccagtaccaacaatcaccagtagctctaggtggaaacctgatcaacgtcgattggttcgtaagacttgatgagaataacaggccgccagtcaagtatgactaccgattcattactgccgatactgccatgactacgaagagttatagcgactactctgtgttacagctgtggggtcgtaagggtaacaagctttaccttctggacatggtaagaggtaagtgggaagcgcctgagcttgagcaaactcttctggactttgagagtaagcacagagccaccagtaaagcggacggtatcttacgcaaggttattatcgagaaaaaggcatctggtatcggtcttatccagtcagcgggtcggacgatgcgaactcctatcgagcctttcgttcctgatacagataagttgaccagggtgatgagcgcattgccacaaattaaggcgggtaacgtaattctgccagactctgctccatggcttacatctttgctaactgagttctcagcattcactgctgatgattctcatccccatgatgacattgtggataccacaacgatggctatcaactgtgaactaaacttagcggacgatccaagggctaggttgatgaggttagcaggtgttagatagcacgaattgctaaagacaatagccacggatggcatataattaactcacttaaacgagaggagatagtaaatgtttaaagctaaatttgtaaattacaaaacaccagcatctggttatattggtattttcactcctggtagggagtacaaactagatgtcattgagaatgacagatattatagaacatacgatgattacggcgtagaggttaagttcaattcactttttttagataattatgtttttgagcgagtttcagattccgagctgtttgacatgattgaggagccagcaagcctaaagtattatatcaatggcaacttggtgcaaaaaagctacttctacgagttaattggcgagctaaatgaggctgatagacttggcgccaaagtgtcttcagtcaaatttgaaatcaagttcgagtaatcaaaactctgtgatacactagcccctactcaggggcttttttattggagaaattacatggtaaaagcagacagctacgcaaacatctttcttaacgggagtgatggtagcgagatttacggaaggtttggcggccttggcttaacagctccagcgcagcttgagcagctttacgtcagtagcgcactggttcgtcgaattattgatatcgtgccagaggttgcacttggcgctggctttaacattgagggtatcgacgatgaaggtgctttctggtcgcgctgggatgatttagacctttcagatagtgtaatcgacgcactggcgtgggcaagattatacggtggagctgctgtagtggcaattgtcaaggatggcagggcgctaactagccaggttagggagggagctgaacttgaaactatccgcgtctacgaccgacagcaaattaaggttcagactcgagaggagaatccacgtaacgcgcgatttggaaagccagttacctatcgcattacgccaaatggttcggccacattctacgacgtgcattacactcgctgccacatcatcgatggcgaaagggttccgaacaacctacgccgcaacaacgatggttggggcgcaagcgtgctaactggtgacttaatcgacgcgattgacgactatcagaactgtgagagactggctactcagttacttcgtcgaaagcaacaggctgtgtggaaagcgaaaggtttggctgatttatgcgatgattctgatggatttggtgcagctcgcttacgcctggcgcaggttgataataacagcggcgttggtcaggctattggtattgatgcagagagtgaagaatatgacgttcttaactctgacattggtggtattgatgcattcttgagccagaagttcgacagaatcgttgccctgagcggcatccatgaaatcattctcaaggccaagaatactggaggtgtatcagctagccaaaacacagcccttgagactttctatggttatgttgaccgcaagcgcaagtcagacctgcttcctttacttggtttcctgattcaatttattgtcactcaggacgaatggtcagttgaatttaatccactatctcaagttagcgataaagataaatctgagattctagagaagaacgttaactcagtttcagctcttgttgctggtggcgtgatgaatactgatgaagcccgtgatacactacgagctattgcgccagaggttaagctgcaagatggtgatattgagcaaaccgctcaggggaaaacagtcgaggaggtagtgattaatgaagagtaaaatgcgttatgacagcgctaaagtaaaagcccgtttcgatgagaacgggtttctagtggacactccagtggttgctcgtgttggtgttcaaacatactacatgccagatggctcagagcgccgagagttccgaccagcatcagaggtgtttaaatccgattccctgcaaagctatcagggcaagccgcttacgcttggtcatgtagttgttaattcagataacgccaaggatgttgtagttggagcagtatctggtgcagctatgcgtcaggattctacagttgtcgttcctctaacagtttacgataagcaggcaatagaaaaggctaagtctggcgttgctggtgagctatcggttggctataacactgttgatattgagtctcctggctggggtagtaacgaaacgggtgagtataagcttgatggagagtacgcaagccaggatgatatccctgctgattgggtacgctttgatgccctgcaaacaaacatcgttgtgaaccacattgctctggtatataaaggccgcgcgcaagtagctaaactgaatctggacgcggaacaggaaaacccgtatactgataccgttcaatcaaataaagaggataaattgatgattaagattaaactggatggcgagcaggagttcgaaatcgccccggaagttgctaagcacatcgaagctgttaaagctgatgcagaacaggcaaaagcaaaagctgacacccttgaagctgagcgtgacgcactgaaagctaaagttgatggcattcctgctgaaattgaatctgccgtagcgaaagctaaagctgatgctgacgaactggccgctctggttgctaccgctgcagaagctggcgttaaagctgatggtatggatgctaaagcaatcaaagttgcttacgttaaagaagtatccggccttgacgttgcagagaaatctgacgcatacatcgatgcggcctttgatatcgctaaagatagtgataaaatggctgaagtccgcaaagcagttgttgctgcggataaatctgacgctgccgacgcgcctaagaaattagacccgcgcgctcgcctcgctaaattgaaaaaataaggagtcttaatatggcaattcgtcgtcaagctactgctggtatggttgcagatacctctctgtacaatatcgatggtgcctgtgtaatgtctaccggcgtagtccagggtgtcggttatgctgttggtgtcggttctgttgatgctgatggtcacaaagttctgatttccgctgttgctgataacgtatacggcgtcctggtgaagtcacactacgaaagcccgcgtggttcttacggtggtgttgttggtaacattgataacttccaggtcgcaaacgtaatgactcacggtcgcatctggatggttaccggccttccttctgctcctgcatttggtagtgctgttaccattgatactaatggttccgcaacaagcggcggcgcagtcactaccaactggaccttcgccggtggtttccaggcagctgacactgtgtctggcgaaccagcactggttgaagttcaggttattcagaaataattagcaaagctaaactaaacctcctccgggaggtttttttatgcctgtaaactggtacaattagtttcactttaaatcggaggaatgaaaatggctagcttcttggaattggtaagagataacattgataagggtttagcgacaatgcagcccgttcagttatcaactgagtttactgcaattaaagagattagggtagcaacatcaatcaccacgccacaaacaatatcaaggagtgatgaaacaaagctaatgtatacaacttacgggcttgctaacgtagctggtggttcatacacaggacaatcgccaaacggagtccagatgaaggttgagtttatgactgactcaactttgttcgaaatcaaaaccatcggctcaatcggcacttactcaatttttattgacggcaaactggtaaatgctgatgcattcgctacgccaaatggagaggcggtgagctggatgcaagttaaagctaatgacggagttatcagcgggaaacttcgacacgttgaaatctacggcatcaactcagcattcggagccttcgtgtttggtgctggcgacacggttagtcgtgaaatctcaatcaagcgcccgcttatttatcagatgggtgatagttatacttatggaactggtgctggattcaggactcaagcttacggctcatctcctgccgtaaatgacttctatgcattcaccaggtctcttggttttgatggtattgctgaaggaattggtggatcaggatggaactcagctgccggtcagtatccaatgtctcgcgtgcaaacaaggcttgcaaagctaaatcgcaagccgtcagttatctcctgggcgcttggatataatgatgccgctgccatcctgactggaacaaatagccaaaagctactagtttcgatgggtgagtgtctcgctgagactaggaaggtttatagtgacgttccaatcatccagattagcagcgcaacgccgaagggaattaccactggaattcagaaggtaattgatttggttaatggtttttgttctgataacgacattccagtaattaacataagtagctatgttactaatgctaactcggcaatttatacaggaacagacaacgttcacccgggaactcttggccatgagtttaggggaatggcaatggctcgcgaggttctgcttgcagcctcgggtcagaaatcactaacagtcccagttacgccgcgtgcatttaacgtggtagcaaggctgactaaaagttttggagttacaatcttctctggtgtagtaaatgctattgatgagaatgatgttgccggacagctatacttgcagactggtgctcgagtggaaattctctcagtatctcgcgcctaatatcaaacctccttcgggaggttttttattgctctttttctgttagactgtcaatgattattaaccaatcaggagataaagatggcttacacagaaattgctatggcggtagggaattcacctgaaatcttagccaggaacgtaaaaatgatgatgtcatctggatttcagccatatggtgacgtccagatgctaagcggcactctctttggcatgaaaatggccaagggaacagcaaacaacgttgaagactttatggtgacatccgacaccacagttcagggattgattaacagggttaaccgatatcttttgcagggctggaaaaggtttggcaatgctcactttgaggatggagcatatctttcagcacttgcgaaaggtgattttgtaagtgatgaagacggaggctcaggtgaagcaggcccacaaggtccgattggtccacagggtccagcaggtcccgcaggcgcagctggtccgcaaggtcctcaaggtccaactggtgcaactggcccagcgggtgcggcaggtgctaaaggtgacactggcccacaaggtccggcaggtccgcaaggtcctcaaggtgaaactggcgaggctggtccatagggtcctatcggcccaacgggcgccacaggtccggctggcccaaaaggtgataaaggtgatgcaggcccagttggcccggcaggattaactttccgcgggatgtacgacgcagctactgcttacgttaaagatgatgtggttacattcaataactctagctggtttgctaccgccgctgtgaccggagagaatccagatgttagcgattcctgggagttgctggccgcgcagggcgctccaggtccgcaaggcgcaactggtccagcaggcccaactggcccggcaggccctgcaggtattcagggacctcagggagagagagggcttcatggtgagcaaggtccgtcaggcccgcaaggcttgcaaggtgcagctggtccagttggacctcaaggcccagcaggtcctcagggtgagcgaggaatacagggtccggttggccctcaaggattgcagggtgtaaaaggtgatccaggcgttaattctacatatacactacctttaaaaaactaccttgtaatagcccttaatgaagaggagggggcgaggcagacattcagggtgccagaagacagttcgggagctgaaatagcttttgtggtcagaaataaagattcttcaaacacttcaccatctggagtttatgagctgggatgtggagtgactggtacggcttcaatgcacttttcaggttggattattagtaaccttaaccaaccagataaaataagatcagcctctatgctaattgcttccatgactaatagtcagcgatactttacgcagttagcaataggaacaaggggtgatctttttaaaggttgcttaaccaatcaggaaactggtgagctatggtacattgaggcttttggtaccaagccaagaggggcagggcaaaccgacttaggtagactctcagttaagattgagaaaagagttgatacagtagttggaagcttaacaaaattcccaagagtttaagctttgctcaaggatgagcacccatgcattgatatagctattgtcccaatcgaaatctcgtgtataattgacacgtaaactcataaacaaaaggatgcatcttaatatgactatcaaacttgacgctttcgagcaagaaaagattactaaccacctgcgcgctatgggtgttgataaggctgatgcggctggtatctggactgttaagcagctcaccgcaagcctgaataaagcttacgaaaccgagtacgaccagaactccgtagtaaatctgttccctgtaagtaatgaaatccctggctacgctaaatattttgagtatccggtatttgatggcgtaggtattgctcagatcgtagctgattacactgatgacctgccgctggttgatgccttggcaactgaacgtcagggtaaagttttccgcttcggtaacgctttcctgatttccattgatgaaattaaagttggtcaagctaccggtcagtctctgtctactcgcaagcagtctcttgctttcgaagctcacgacaagcttcttgataaactggtgtggtccggctctactgctcacggcatccctagcgttttcgactacccgaacatcaacaacgttgttagcgctggctcatggtctcagccaactactgcggtaagtgatattacaagtctcttggatattatcgagacttcaaccaatggtcagcaccgtgcgactcacctgcttctgcctactaccgctcgtcgtatcatgcagaacctggtacctggcacttctgttagctacggtgaattcttccgtcagaacaatagcggcgtaacagttgagttcgttcagtacctgaatgattacaatggttctggcacctctgcagctatcgcttatgagaaagaccctaacaacatggcaatcgagattccggaagcgactaacgcactgccggctcagccgcgcgacttgcacttccgtgttccggtaacttctaaagcaactggcttgatcgtgtatcgtcctttgaccatggctgtaatgaaaggcatcaccttcgcgtaatagcaattattgcttaccacttgccacccttcggggtggtatttttgtttatatgactatataatcaaacaatcgaaacaaaggaggaaagaatgaaactgttacataaaggtgcttgtgttatccgtcttggcgcaaaagattatcttccaggcgacaccatcgaggttgaagagttatcagttggattaaagattctggtagctgaaggcaagcttgaggttgaggatgaccacaaggcaactaaagaaatcgagcaggaagttaaagccaaggctaagccgaagaagcaaccaaagagtattgatgaagctgagaatggcggcgactacaaataaaccaagagggcgcttcggcgtcctttattgtatggagatataaaatgaatgaagaagtaattgcgtacatgcgcacgctttacccgcctcttaagggtcagcctgatgatgttcttaacgcatggattgaggtggcaaggctatttatctgcttagataagtttggcgacaagcaggttcaggcattggcattctacacgcttcacttgcttagccaggatatcgcactgaagactgagaatgattcaagccagacatcctctgaccgggttaagtcctactccctttccggcgaatacactattagctatgatacaagcacagcttccgcaagctcatctaaccttgaggcttcatcatggggtaagctttacattgatttgatgcgtcgtaaagttggccgctggggtttgattacgtctggtgggtcgaggtgctgccgatgaatcacgcactcttgcagcagcagatcaaggctggtattaatctcctgtcagatggtgatggcgctttcgaagctactacccagccaaccatctcgatagtaaatggctacgaagtgcgcacgcctggcacttcatacgcagtgaggggtgttatccgtgaattcaaagcgcgagacattgacggtgacatcatcaaattcggtgaccgtcgcggaatttttactgctgattcagttgtatcggaaggcgaccgcatctacattgaccaggaggcctacacagtcattgacccgcgaccagtgaagccaactggcacggtaatcgcctacaggccagtattacggagggctgctacttatggctaatgacgttgtaagtttcaggaactcaattaacgcatggattgatggcgtcactgatggtgtagaattgattgtggaaggcacgctaactaaggctgccaacgacatagttaagctatctccagttgatacaggtcgattcaggggtaactggcaggccactggcaattcaccagccgcacagtcactaaataattacgaccctgacggcagtgagactcgtaactctcttcgtaggcaaatctacgcactagcaagagatacaaatacgaacgtaatttacgttaccaaccggcttgattatgcgcaaggacttgagtttggttcatccaatcaggcgccttctggtgttcttggtgttgtccagaagaggcttggtcgttacttcgccgaggcggtacaggaggctaaacgtgcactatgaaatgatggtagcatcaagaaagctggttagcgatgctgcggttgatattgccggcggactaccagtggcttacgagaactgcggattcacgccgcccaaaaacggaagttcatggctgaagtttgactacacggaggttgatagtgttacgtggggattgcagagaacatgtcggtattacgttggcatggttcaggtctctatattcttttcaccaggtgagggtactgataggcctcgccaattggctgggcgattgtcagaagctttcgccgatggtacaatgcttgacagcggatacatttatgaaggcggttctgtgtttcctccagtgaaatcacaatccggctggttcattcctgtccgattctacgtacgtatggattaattaaggagatttacatggcccatcttagcaatggcacacaaatttttttgcagggttccaaatctgaagcggtagccgtaacagctatcactaacgcagctcagccagttatgaccgtagctgatgcctcaactttcgcagctggtgacttcattgttgttgagtcatcgtcatggtctaaactttcagaaaaacagttgcgagtagtaacatcaacggatacaacaattaccgttgaaggcattgacactaccgacccgcttcagttcccagctggcggaacggcatcgatctacaaggttcttacctggtatgagatgccttgtgttcaggacgtttcaactgatggcggcgagcagcagttcgttacctatcagtgcttggctgatgaccgtgaacagcagattccaacctataagtcagcggtaaatacgacctatacgtttgctcatgagttcaccaaccctatctacccggttctccgtaactacgacgagtccggcgcactgattgcgattcgtgcatatgtaccaaaagctggcgaagttcgcctgtggaccggaactattgcttttaacgaaactccaaacgtttcagttaacgaaatcgaaactgtatccgtagcaattacggtacgtggacgctacagcttcctcgctgcataacaatcaagccccttcacaggggctttttttatgttataatttcaactcaaacaaacacgagaggattatttaaatggctaagttcaaattaaaattaggcgcactccctgatttcaaacttcctgttaagttccagatgatcaacggagaagaagctgaggttattttcaacgccaagcatcgtaaggctaaagagattcaggaagtattccagactgaaggccttaaggactttgactttgttaaagagatttgcagcggttggaaccttgaagaggaatttaacgacgagaacatcgaggagctggtatctctgttcccagcatccgttctggcactgactaacgcttacatgcaagctctggcgggccagcgcgcaaaggtctaaagcgcgcagtatatctacaataccaaagagagccaacggacgccgaacttgaagctattggcatgcggcgttccgattatgaagatgaagagccagaggagttatacttcgatgatgacatgatgctggcatggactgtttaccaggcaacttcaactcaatggcgtgtaggtatgaacggcgctaccggaatagattattcagtactccctttcctctttgatgtgtataatgtcaaggacaaagagatgactttaaatgacttgcgaatactggagtgcaaagcacttgagatgatgcaagtaaggcaaaaataacctccctttgtggaggtttttttatggaggttacatggcagaatttgcaggtatcactcttggcgttgacgttcgccaggttgaccagggcacaaagtccctgcaagaatttaaacgtgccaatgagcaggctgcggctggtgttagcgaatttgttaacgctgagctagttgcgaagaatcaggctcgcgatactgccagatatctttctgagcagcgaactgctttccgtcagctgcaaaccgcaatcgacccaacggcaggaaaacttcgcaaactacaggaagcggctgacgcactggataaatccttctccgcaggagttgttcctgaggctgaattctaccgcttaagcgaggctcttgagactcagactaacaggcttcgcaactcacagcgcgcattgactgaggaaggcagggcggcaattgaggcatcaaaagccaaggctcaggcagctacacaggcggaaagattccttaagtctttgcaggctgaagctcaggcggcaacattaacgcgagaggagctgttaaagctcagggctgctgagttaggagtctcaagccaggctgcgccaattattgcacaaatcggagcagcagctgaccagtccgcagcggcattaacaaggcagagccaggctttgcaacgttccgggctatctgttggcgcatataagaacgcaatacgcacacttccggcgcagattacagatattggaacctcattggctggcggcattccaatctggttaattgcaattcagcagggtggccagattaaggatagctttggtggtgtagctaacacattcaggtttgcgcttgctgcattaaacccgttcgttgttgcagctggagctctcggtgttgctcttggtgctcttgggctatcagcttatcaggcttatcagaacacatcacagctaaaccagacgcttaccctgaccgggcaatcagcgaacttatcagctgcagcggttcagaacctagcaaggaatgctgctgaagctgccggagctactcagggtttaggccaggaaattgctaatggattggtcgcaagtggaaaccgcacggtagctcagatttcaattatcactgaggcaactgcgcgctgggctacggttactggtgattcagctgacgatatcgtcaagaacttcgataaaatcgcaaatgacccggtcaaagggctggctgagcttgataagcagtttaatttcttaaccgctggtcaacttaagtacatcgagcagattagggttacagagggtcaaactcaagctgtaacggccgccacgaaaatatttgctgatgtgatggagaatcgcttaaccaaagttgcagagtcgctaacgccgcttgagagggcttgggatagcttcaaaaacttcgtttctcgggtttggacagatatcgggaacagaacgcttggcgcgctaaacctaattgtagacgttgttgctggcactattgagcagattcagtttctgattggtcagggtgacgttcttatcaacaacttcctgatatcgacaatcaaagcattccagaatatccctggcgctgatggagttggtagtgagttggttcagcaatttgagaagcaaaacgaagggataaagaaagctaacgaggagttagttaagtcagtagctgagcgtgacgcaaggattcgtaagggtgagcttggttatgtcacctcaactcaggaggagcagcaaaggaatggagaatctgacgctgagttcgagaaacgcagaaagtcacgtgagcaggaacttaaagatattgaggcagcgaataaggcaaggaagactggagttaaggaccagcaagaccttactatcaactatgagtcaggcgtcttagctctacaggctcagcttaaggttcttcaggaacaccgccagattagtgatgtcatcagtaacgagcgaaagcagctgttcgcagaagaagcaaggtttgcaatccttaatgaaaggctggctgatggcactatcaccaaacagcaaagggcgttactgctacagcaagataaaatcttaggactggctcgtgagaaagctgagattggtgaccagattgttctgcaggaaagggccaataaactccttgatgataacatcaagaagactcgccagattaacgctgaagcagtatcaataagtgttggcgctggattatctcagcgcgaagctgaaaggaagcgagagttggcggcgctagaagcccagcagatttctaaaggcggctccgtagatgacactgacttccaagcattgttgcaggctcgtcagaatttctacaatcaggaagacgcattacgtggcaactggttggctggtgttaagtctgcgtttgctgagacggctgatgaattagcaaacttcaatcagattggttctgaattggcaatgagtgccttcaatggattgactgaccagattacaaacctggttactaccggagaggcaaactttaaagagtttaccgcttcaattctgaagcagattgcacgcattgcaacgcaattacttttgattaaagctattgagtcaaccatatctagttttggtggtggcggcggctcaacaggtacagctatagctaactttggtaaatcttttggctttgcatctggtggctacacaggtagtggtggtaagtacgagccagctggcacggtgcataaaggtgaattcgtatttactaaagaggcaacctcaaggattggcgttgataacctttacaagttgatgcgcggatacgcaaacggtggggtggttggctctggtcctggctatgcgactggtggacttgttggtggaagcaacgttaacgttggtggagtgaatgttaccgttcagacaggtcttggcggtggtggcggcaatgacgctaaacagttagaatctggtatcagggttatcatcgcggaagagattactcaatctttccagcagggcggaacggcttaccagttcttgcgtggttacagttaataaatggggcttcggcccctaaggattttagatggcattggaaacatttcgttggtgtacacaaattcaaggtggatcagcaaacttcaccaacgcgaataacgttagggtggttagctttggtaatggctacgagcagcgtgggactggtggctataggaccaataggcgcacatacaatatgacctacactaacactaactggaaggaagtgttagacttctgcttttcgcacatcattacaccttttgcgtggacaactccgcaaggtgaacttaagctgtttgttgtggctcaagatagcatcagcgtcacaccaaatactaaggaagtacagactgtatcaatgcagtttgtagaagttttcacctcgatgcagtaaactaagaccctacggggtcttttttattggagaaatatcatggcaacgccattaagcactaagtttgagaatcaattacaaagcttgttccctggtgaggtcgttacgcttatcgaggttgacggaggaaagtttggcgcaccagtttaccgctttcatggggagaatatcagctatacgccagaagaaatcatgatggcacaatcaacaggtcagccactgccagcaaaggcaatcactttccgtggagaagagtatggcgcaaggccttttggcattcagggtattaacatgacttctgacggcaaggcaaacaaggtaactctggttgtatcaaacgttgaccagaacatctcggcgctcatccgcacttataatggtcttgttcaggctaaggttactatctggataacccttcgtgagaatattaatgaagatggcaccattgctgatggggattaccgtaagctagtttacttcattgagcgacctaagcaggttgactacaacacggcgtcatttgaactaactagcccaatggatatggatggtatctacattccggctcgacttgttcagtctgtttgttattgggcacagcgcaatcagtaccgctcagggaatggatgtaactacatgggcaatcgatacttcgataaggacaacgtgcctgtgactgacccatcccaagacttctgcgccggaacggtgaccgcctgtaagttaaggtttggagctaacaatcaattagactttggcggttgtgcggctgcaagtctgcaagcgaaagccaaccagaactaaggagttgaaaatgaaattattgtgtgcttatttgatatttatatttttgtcaatgtttggattgtcattaacattaattctcaatatggctggtgttttatgattacacctaaagttaaactagaaatatttcgccacgccaacgaggtttacccgcaggaatcttgcggggttgtaactcaaaagggaatggcgcagaaatatcacaggattaccaatgtatccaaaactcctgagcaatcattcattcttgacccagcagaattcatggagatttcagatagtgaacaaattgtttacgtggttcattctcatactggtgacggtgccactactcgccctagcgctgcagacatttgtagttgtaatgagtgcgaaattccttatgtcattgttagcattcccgaaggcgatttgcgaattattgaacctagcacaatgcctttagctggcaggccgtggggtttgggcagcttcgattgttggagtttggtcatggaatttcacaagctacacggcgttaagctgaacgactaccgagttgattaccagtggtggacgaatgaataccctgacaatatctacgatgataattggcaacttgaagggtttgagttagttcgaggtaatgatattcccattggctcaatggttatgatgcagattcaaagcgagaagacaaaccacgctgcaatctacattggtgataataaaatcctgcaccatttatatggtaagatgagtaaggttgatttgtacggtgattactatcgtgagcggactgtgcgaatcgtaaggcataaagatttaccggaggatgctggttatgacccagaacgtgattgatgttaagttaggattaggtttaggcaggaagtttggaaagctacataaactgtgcgttaagacagttccagaagcaatgcgggccctatctgtaaacatccctgaatttaaggaattcatgcgtagtcatgttggccagaacacaaggtttgctgtattcgttgacggtaaaaatgttaacgaacacaagattaacgacctgcagactgtgcgtgaaatcaggattatgccaatcccacaaggtcgaaaatcaggaggtttattccagacaatccttggtggcgtacttctggtggcatcttacttcttccccgttcttttgccagtggctgtaggccttcttgctggtggcgtagctcagttattggcaccgcaagcgacaggattgaatgaccaggcatcacaaacaagcaacagggcttcatacgcatttggctcagcagtaaacaccattgctgctggtaacccggtttgtttgccttatggttacaggactgttggtggcgccgtgtttagcgctggttcatttgctgaagatattgtttaaaattacaacccgcctagtgcgggttttttatttagtgtagaatggcacaaatggttaaacaaacaacgaggttatatgatatggccgatttgccaaagatttatggaagcaagggtggtggcaagaagccacacacacctgtggagcaagaagataacctggtttcactaaacaagattaaggtgctgctggccgttgctgatggtgaggttgattctagcttctcacttaaggatgtttaccttgctgacgttccagtgcagaaccaggacaactcattcaactatgaaggtgtaaccgctgagtttcgcccaggcactcaatctcaagattacatcgccgggctagacggtgaggcatcagagattcaggttagtcgtgagattaacaatgatacaccttacatcatcgcagttaacaacagtcagctttcagcaatccgagtcaagctgttctggcctcgactcgttaagcaagaagagaatggagatttaaatggcacaacatgtgaatatgcaatcgatttatcagttaatggctcagcgtacactgaatataccagaggcgtggctaacggtaaaactacaacaggttacgaccgcagtatcagggttaacttaccagccgagtttagcagcgctcttgttcgtattaggaagttaacgccagactcaacaagcagcacactggttaacggaatgcagattacaacctatcaggaagtaatcgacgctaagttccgctaccctcttacagcgcttgtttacgttgagttcagctccgacctattccccaatggcatcccaacgatagctattaagaaaaagtggaagcttatccgcgtaccgacaaactacaatccagagacaaggacttatagcggcacatgggatggtacctttaagatggcgtggtctgacaacccggcctgggttttatatgaccttgtggttagtcagcgttacggattagatcagcgagaacttggtgtagagattgataaatggggtctgtatgaagctgcgcaattctgtgaccagatggttcctgatggtaagggtggaatggagccgcgatatacttgcaacgttgtaattcagcagaaggttgaagcataccagcttattcgtgacatctgttctatattccgcggtttaaccttctatgatggtgagcaaatcgggattgttgtagacaggccgcgccagccaagttacgtgttcaccaatgataacgttgttgatggattgtttaacaggacattctctagcgataagtctctttacacgactgcaaacgttcagtttgatgacgtagagaataactatcagcaagatgttgaaccagtgttcgaccttgaagcaactcgccgctttggttataaccctgtagacctgaccgcaattggatgcgtaaggcgtagtgaagctaaccgtcgaggtcgctggttgctgaaaacaaaccttcgaagtgaaacggtaacgttcacaactggcctcgaagggatgattcctatgattggtgatgtaattgctgtcaatgaccaggcttggtcaagcaactacacattgaacctttcgggtcgaatcgttgaggctactggtctgcaggtttttgttcctttcgctattgatgcggacccaggcgacaggattttaatcaacaagcccgatggaagcccggagtacaggactatcgcttcagtatctgcagataagcttacgcttgaactgaacacagcattcagtttcacgccgcagccggatacggtattcgcaatcgataagcagaatctggcgttgcagcagtatgtggtgaccgggattcaaaaagctaacacggatggagaggactcattccagtacagcatcacagctgttcagtatgatcctaacaagtacgatgagattgactacggagtaaacatcgatgacaggccaacaagcatcgttgaccctgacaggattttgccaccgcagaacatcaccgttactagctacagcaaggtagtgcagggcttaagcgttgagacgatggttattggttacgacaaagtgcagtatgcgaaaacatacaacgtacaatggcgtaagaataacggaaactggattaacgttcctgagacggctaacactgaagttgatattgaaggtatctacgctggcatttacgacgtcagggttcgtgctgtaactgaccaaaaatcagtatcggcatggtcagaaatcacaactgttagcctcactggcaaaattggagaaccatctgcgccgcctgtaattacggcttctgatgatgaggttttcggaattagggttaagtggggcttccctactgactcagcggatactgcgtacaccgagcttcagcaggttcctgataatggtgacggtacatacaatccagagaatgcatcactgcttaccctggttccttatcctcagtacgaatactggcacacaactttaccagcaggtaacgtgaggtggtacagggcgaggattattgacaggataggtaacgtatctccatggactgattttgtcaggggtatggcatctgatgatgtaagtgcaatcattggcgacatcaaggttgatatcgaaaactctgatggttacaagtatcttctccagaacgccattgatgcaaatactgacatccagaaccaggccgaagcaataattgagaacgcattagcaaacgatactgacgtgcgcgttatgaagcgcgagaatggagcaaggaaggctgaatatcgccaggctgttagtttgattgctgatgaaactcaggcgcgtgtaaatgctctcacagaacttaaagcgcagattgatgatgagattgttggtcagattacgacaattgaaactgctttagctacagagaccgaggcaagggctactgctgataccgctctaagcgcaaggcttggtgataacgaggcggctttgaatcagaagcttgactcttacgccacggtcgaaggcgttggtgttcagtacggcgttaagctaggtctgaagtacaatggagttgagtatggcgctggcatgagcatggagttaactggtagtggtggaaatgttcgcagtcagttcattttcgacgccaacagatttgcaatcagtaacggcattagttctggttccggtcagtggtcactgccttttgttgtcgataataaccaggttttcattcaaagcgctgtgatacaggacggttcaatcactaacgcgaagattggagacgcaattcagtctaacaactttgtagcaaactctgttggctggaggcttgataaggctggaactttcgaaaataacggttctacgcctggcgagggtaaaatgaagcaaactaaccagacaatttcggttgctgatgctaacggaaggcttcgtgttcagattggccgtttgactggagtttactaactgatagaatgggcaaatggaattgcccttatcaacaggaggaatttatggctgagtatgggattgctacatatgatgcaaatggtaattacaataactatgggattaagccagttacggttgttggctttgatttcctttccgctggcaataattcttactcgttttcttactcaataccagaaggcacaaaggttggattcactattagtctggatgatggggcgatatctggaccagcaaggagaatagtggcaagtgggaacacaataacgataacaccaacatcaacaccaggacctggtgtttacccatcatcaaattgctacctcatagcttatctggagaatcaataatggctgattacggagcttttatagatgtaaatggaaatccattcataacgccactatcaacaccattcgcactttactcaaaaggaacaatcgcatcaggtaatgttaacaacacccagtatgctgatagatatgttgacattcctctcaatgttccagtgatagctttttgcaaaacgacaaacacaaacaatggtacagctttgtcagcattcacatttagggagggatccaacattggaaagatctactttcagggtgttaatccagcaaatcaggcgtttgttatgacgtactacatatttgcgatattcccacagactctacctgattggggtatggctatatgggatgcgcagggtaaattgatacttacaaatgaaacaaaggttcttagcgacctagcaacaattggcacgccaggttatcaatctggtggtttaaatatagacgtaacattgcaaggaagttgggccgtggttccaacaaccctggggaatagtcagatacaaataggaacgctaccaactggtcagccagttataacaaatgcgacagctggaacatcctgcaggtacaacggagtgcagacaagaataaacgcgcagtcaacacgtggctctggaaatgtgttaagcacaacaaataacggaaatgtaataacagcaattaacacatcagcatacgactaagcccctttcggggctttttctttatcaacctccacaatcgtggtctttaaaattccgctcagagacgtactgaaacgagaatggatatccggccctaagtaaaaactcctcaccgcgcttctgcgtgccaaaaacataaacagagtaactcattccgcttgactcataaatcgccgtacaagtgcgctccggcatcgtagagcacccgcctaacgtcattgctgcgataacgattaattttttcatctcattcaccttagaaaccgttaaagtttgaagccagcagcagaacccaaacgaagaagctggtagttgctacgccgaagattgcagagattaagttagtggttaagttagtcattttgtattccttagtaagtatgtttcgtttcgatggagtaactatagcaaaggcttcagcggtagtctttagcaaatcgtgctatttgatatacgcgtaaccgatgtaactcgatgtatacaatctcatccgcggaaaattgtatacgcttttttacgcgcagatacgcattagttacatttataaatccttatataataaggttttagagtagtattattattatatatattactatgtatatcttgtaactactctctatagctatgttggtatgtttttctaaaagactatgtttgatttcctgttaaggaggaaatgcatatagatatagatagggtgcaaaattggtggatacattggttacaagagttacattcagcatccatgcggcctagagactagcaaggcgtatttaggtgcgttttacaccgatatacaaaatagcacgattaatcaaaacggctgcttcttgattgggtatagtgcactcatcggcagcaatggtgctgcgtctatctaccaaaaaatggtagatacaaatgaaatagctcctcaacttgaggagcaaggataagagagaagataatgaacttaatcaataccaagaaagaaatgaccatgacgacaactgagattgctaagattgttggtcagcgacacgataacttaatgaatgatgttaaatcaatgtaccttgagttgtatggtgaaaatcattctcctgagattcaggagattaaaattcacaacaacagaagccaaaaaattgcaattcttgataaaaaacacacactatgccttgctgcaaagtacagcgcaaaggttagaatgaacatgatcgagaagattgagagccttgagcaggaaaacaaattactgaaagagcatatggctaagatggtttcaattgacgagatcaaagtttataagatagaagctgcgtcagcaaaagctgcacagcacagagctgaagataactattacgcaattgagaagttcatgtttaagaacatggataagtgcggaaatcctgcagaacttgatgagcaatacttcgatgttaaattcgagtcaaatcgttaccatgactctcaagaggttgtttacaagtaccaggcccagcttgaggttgcttgcgagaagttaaaggccaaagatgagctgattgctaatctggtagacaagaatagcgagattcttaagttgaaatgataggcaaaaccaattggataaacttatccacggatggcatagttaaatcacacaaacaaagagagatatagaaatggcatacttcattattcaagagcgaaacaatccgattttcggcacggtatactactgcgaggatggttccggatactgcgaccacaaagctgacgccaagagattcgatactaaagctgaggcaatggaatggggcagcattaacgatgaggagctgggtggaattgttaaggtgattaaggttaaggagtaattcatgagcttcaaggtttacactaacgatgagttaaccaacgaagcctaccatgaggagtctgaccatgtgtctggctctggtctggctcacatcttctcaacttgcccagccgcatacaaatacgctgagcatgatgatagcagtaaagcgttaaagttcggtacattggctcacacgatggttttggagagctctgtatttgatgcgacatactatcgtcagccagcgcaggaagagtttgaagacctgattaccagtaaggctgcattagcagcaagactgaaagcgatgggaattgctggaacttctggaaaggattaccctgaattaatggagatactggcactgactggtgaatcactcaacgtatggtgggatatccagcgctctagcgagattaaagcagaaggccgcgagattgtatcagctaaggactttgacaccgtacaggcgatgcgagaggttttgtgtggaattcctgcttacaatgcaatagttaacagtgaaaccgctcagcgtgaactatcaattttcggtgagattaacgattgtggagtgaaggtaagactggaccatgttgatgtagttggtgatgttgtttatatccgagattacaaaacaactagcgacgcttctccgtcaggtttcggtcgcctcgcctttaagcatggttacttgttaaagatggcacttcaacatgacttatttgtgcgagcctttaatgaaaagaggcgagttgttgttcagctattggcgcaggaaaaaaagagcccgtacctaccaatgtgctacacgataacaaaagaacagttaagggttggtaggttgcaatacatgagtgcgctttctacatacaagcattgtaagaagcttgatatctggcctgggtatgggttcggtgaaacagagatggaattgcagatacctgaatatgagatgaagaaatatgaattggcatgatatttttgagtatatagatggatgcataatatggcgtgctagtggtaatgttgctggttacaaacgaaaggatggttatgtgattgtgacaataaatggtaagaaaatactagcgcatcggataatatacgaaatgaataacggagatatagagccaggtatgcaaattgaccatattgaccacaatccatcaaacaacaggattgaaaaccttagggtggttaaccaccaggagaaccaatccaataagtcaaagcagtcaaataacacttcaggggttactggcgtttggctacataagaaatctggaaggtttgtagctgaaataatggttgaaaagaagaagatacatataggctactttgatgacaagctgaatgcggcaaaggctagaaaggatgctgaaattaagtttgggtttcataaaaatcatggaaaatagcacgaatagctaaaacaacattaaatcggtgaggtatagttacctcatcgacaacgagaggaaaagtatgaataccagcgacaaaaacacaaacgttttaaaggctctatttgaagctaagagcaagtttgccaaggctgaaaagtcaaagcagaactcgcacctcaagaacaaatatgcaacattagatgacgtactcgcagctgtagagcctggattggaggatagcggtcttgtgatgttccagagcatgattgagtcagaagttgcaaatcagattaaggttgagactaagatttatcatgctgagtctgctgaatgggtttctttcctgactatcgttccgttggctaaaaatgactgccagggaaccggctcgtcattaacgtacgctcgacgctacgctattacggcagctctcggtcttagtcaggctgatgatgacggcaatcttgcagtcaagagcgtcaaggactggcgtaaagatgtggaaaaagcagagtctcgcgatgaacttgtagaggtttacaaggcttgtaaatcacaagctgatgcagcaacgtggggtattgtagagaaggccatcatcgaaaagcaggcggagattaagatggcatctgcgagcgggttcaatccagctaaaccaaaagaagtaactaaagttgttgcaaatgcaccgagtgaagctgtagaatcacaatcaatcgaacggttctaaattaaacggggcttcggccccaaaatcaaacgagaagagaatataaaatgcatactttaacaggcgtaattcgcaaagctccttacaccaaagatggtcagaatgctaaaggcaaatggaagatgtacgctatcgagatgagcgaatcctacaagactaaagacggagagcgtaaatatactaactatcgaataacgatgtttgctagtgaggcgcagattggctggtatgatgaggcatttcaggaaggaaaagttatctctgtgagtggtgattcattggtggttaatgagcgtgagcataatggtaaggtctacatcactctggagtttcagaatcctcgattaatgtttagccagcgaggtggggaatcggaaccacagcaacaacaacaacgccagcagcctcagcctcagcagcagcgacagcagccacagcagcaaagccagttcgatgacgatattccgttctgatgtaaaatataaagcccctttcggggctttttttatattgctctaacctgccaccttttatcataaaagtgagcaaatccactatatgttaatttaaggtggcaaaggaatgtgcttaccgatgcagttggtgttaaaatcctcaggaatgtctgaccaccagtcacgtacttagtaatagaaaccccatcaagagaagtgctttttgagccagtcgacttagctatcttgttataccaaggtattcctgatgagacattggccttagtgcttccagataagctaaattgaataatacctcctgattcctgaccgcctaatccattcttattaattggtataaggctcaactctccagcaataaatgttgacccatacctggactcctcaccaactgtagtaagaaggatatcaagcgccctgttataaggcagcaataaagtagcatcctcagttctgacctgattgaagtccattccactagtaacatgaacagcagataacgtagttccgttatatgagttccttgcttcaactggtgactcgccatatgtcacgttgccaactttagtgctcctcaacgtgctctttgagaatgaaccagtgtattgactgttaataatcctgaagtcatcaccaaaatgaacagagttaccttctgcagttgggtttgaaatggtgttttccataatcatcaaggcgtaatcagacttgaaataaccatcgctaaaacgtatcgatccaactggcattctactttcattagctggcaattttatcatcctaaggactccagtgttcatgcttgattgaatccagcaagaaaacccctttacatcaaatccaaactgatcgtcatcaccaccatagtcggagaaatcaaatacagtatctccattaacaccctcaaccccagcacctacgatattaacagaccttaactggccaccaatcttgtgtggagttaagcaaccatcagcagctatgtttgtcgcagtgacatacataacaggaaaaccaccagctacaggctccagggttgttgtgttaatgccgtaaccccaaagaaagccaacatcacagtggtgtgcccatacagaatcaagggcggtacttgtattacctgaaagtccaatgccgtatgtgcaatcgtacatgtatacatttgaaattttagaaacaaatgtcagtgttgataatgcatacttgtaatgataaaactcaacgttatctattgtgtactgcttgccgccaccaccttgacctgagtcatttccgctaattagaggtgagccgttataatcagcatctgcgttcctgaagccaatgtttttaacaaacatattgtgaccccaaggcgaaacaatgaagccaccattgccagatgtgtaaatcaaacacctcctaggagttgctgtaccttcaatcctaattgtctgtcctgagaacctctcaccagatacgttgacccttgttgtgccaatgtagataggcctatcaatgagaatcttcttgtttaatttgattgatgctgtgtagcacttctgcatagcaacgccatcgttagacacgccagtcaaatcagcggcgcccatgcttggtgcttttggatatggcgtaccttggattgtatttccatcaatatatggcgcgttcatcagagcaccaaacatcattggtgacaagccttcaatcaatgaaagatctcgcttccatctgtggtttccggtagtgacaataacaacaccatcatcatctgtgctggttgaatcattggcatcgtaatagaaccagccaccgccaagcatgctagtccctgagtgactagatacataaacccgctcaccgtcacgaagtggcaccaagcccctcaaaatagataagttatcaacattacgatcagcaaatgacaaaggcacccatccagaagatgaaacccctccagttgactcaggggttgagttagccgggacggttttaggaagcgcgcccgcccaaatgtaagggacagcaataccagatgaaatgtcaattacctgttgagttgctgattgaatagttacgccagactgaaatgagccaatgagagcaccagaaactgactgagctgctgactcagcactttgagcagaggatgctgcgttagatgcacttaaacccgctgcatccctcgccgcctcagcttgagataatgaggactgaacatctgccttatctgccgatacttgcaaggcatcactggcaacctgctgagactggttgtttacgtttgtgacattttgctggaatgcatcagcatcaaactgattaaaagcatcaacagctgctgcgacttcagtctcatttgactgatagtaacgcaaggtttcagcaacatcctgagcaagtccctgaacagtaatcccgtcgtgagcaagaattgagtactgagtaccagtcggagcggtaaatcccttgtcgttaaaaactcgaatttcggtatcactgattatttcagcaatggtaacaatacttgctggcgtggtattgaaaatcattgttgcgccaactcgaattagagttaacggctgcctccaggtagtaccaacaccagttacagttccgtcagctgcaagcgatgctgttcccgcgtcataaattgccattttatttctcctctttgatagatgaaacctattgtatcagattagttgtaataaaaaaccctccgaagagggtaattgttatgaatgcttatctatcagatcttgcgggttatataactttcgctcaagtcccattttgaagttcccaccgtttggaactacaacttttaggcctctatcatcagcaacgtaaagtgattcattgtcatcagggaggcaggctacccgtaattcgcgttcacctccgagataacgatacgccactatttcaagattttctggcgtgaaagtaacccaaacctcctgattggttgccaccttaacacgataaccatcaatcagatcgcttgtcatatatatagcagcatcaggctggccgcttcctagcttaacaacagagccacgcgaataatcacgcgccagaaatgtgtactcaccattatcataagcaaacatgacgttacacatttcatcatcaataccgtcagcgtgaaccatgtggcatggcaatgcatgtattagctcttcagagccatcatggcgcaatttaacaccaacgtcataagaatcttcagttaggcactcatacacgcttaaatcggtgttctcgcgcttttccgtacgctccattactgctacacacgattcatgatcagccatcttacctaatcctttttcaggtacgcgtgacgccctgcgataagcccttgccttgtaatcctgcggaactttaccaaggaatcgaccgagaatgttaataacctcactataaggttctccagtcaacttcatcatccagccaacaccagagtcgttaccgcattggttacagatggcgccaccgtcaccaggggagttaatattgtcagtccagcggaagcggtcttttcccgagcagtgagggcatgggccgtgctttttgctaaagtatgaatcattaagcccgcatatagattgcagcgcctccctccagaggcctttcatgtacggaagaacctcttctttctggtaacttatctcgctcactgtatttactccaataaaaaaggttgcaccgattatggcacaaccttaatttttactctttagcttttcgtgctgcttcattagctgctttaattttacgccaagagcgacactctggtttggtagctaactcagcatcagtaaccacgcgcagcatgtgacgcttcttgcagcgcagagtaagtggcttgccgttaccatcaaattgaaggtctggacggcagaatgtagcgcggaacccttcgccagttcgcttgtatcgattgtgagcaagctgggcgccacgtgccgacatcatgccgcgattaaaccactcctcaacagcctgtcgagtaacctttaattgcttcgccatattagccttgctgccgtagaagtctaaaacaatctcaagcctcgcccttaaacccgctcttacttcatcctttaacacatagtaacctgacggtcgtttgcgaggttttttgtcttctgttcgtattgttccgttattaccgttaagggtacgcttatcaatttcacacacttttatcacctcgatagcactttttgttaaacattgtctttgatggctgttattataacgtcaatcgaacgaacatgaaaggcatttgagaacatgactatgcgattgaaatcaatacaaaaacaaattgaagaactaggcaaagataagattaaagagattcaggaaaaattcacatcatcaaatggcatggttccttacagctatcagtgcgtgatgtatgacgagatcgccaagcgcattggtaaatataaatacccattcatcgctatggcttcagtatccgctggtaagactctggttttcgccatggtcgcaaagcgttgctctgaacttggtttgccgatgcttttacttgcgagacaggctgagcttgttagccagagcgcctctgaaatttcagactacggcgttcctaactctgtctattgttcaggccttggcattaagtcctcttatttccctgtaattgttggctctgaaggtacagttgttggtggccttgataaggcgcttggtgacttctgccccgcagtagtcgcaatagatgaatgtcacatggtagatgaccaggatatcgctgaagcaatagacaacaatgagacatctcagcaagcgagagataaaggacgaagccagtacacaataattatccttacattgatggagagatgccgcgctaagtatggtcgtgaattgagaatatttggcctgactggttctcctttccgcgggaccgcgccaattgttgtagagaaccttaaggaacttggattctggcgtgaagcagcgactaacattgataccaactatctggttgagtttggctctgttgttcctacaaatttcgggtctactgatggtgttggctatgacctatctgagtttgatacctcagctgatgatggtgttcaggacttcactaaatcccagctagaagcaatggagaagaagattcagcagtcgggcacaatgacagctgagattatgaagaaggtgtggttggcagctaaagaacgaaacggtgttctcgtgacgtgcgctggtgagcgccattgcaaggaggctgcaagctatcttcctgaaggtgaaacttactgcataattactggaaaaactggtgagaagcagcgtaaggaactactggataagtgcttcactggagagattaaatattgcttccaggttcaggcgcttactactggggttaacgttccaacatgggatactagcgtaattcttcgcaagattggcagcctaactcttctagtccaacttctaggtcgtggaatgcgcaaactgaagaagctacatgaagacaagggaatggttaagaatgaccatttagttttagatttcgctggaactatggactcgatggcttcactgtacttcaatcccattcttgagcaagctcagtatcagctacggaagagtaacggcaaggagactaagcagtgtccagtttgcggaactgagaacagcttctttgctcgccgctgtatgcatgttgacgaaagcaataatcgatgtgaatacttctgggttagtcgcacatgcgaagaccagaaagaccctcgcactggtaaagttatagttaaaggatgcggggttcagaatgacgttgcagctaagatttgcaggggctgtgattgcacattacttgacccgaacctaaagttaagcgggaaacattacagaaaaaacgattggtttgacgttgttgattttaaggttggactaacaaagaaccaatcaggaatcatctataactatgtgcttgatgatggcatgggcggaaccttcaaggcttatgaggttttcttcgtagagtctgaccatagagtatgtaaaactctctggctgaataatggaattaaaggtcacgtagttgatatgaatgccaagcgatatatggctgcatatcgaaatgctcgcaagattatggagtacgcgcagtacattcaggccccgaagcgagtaacacaccgcaagaccgctaaaggcggagataacatggcaaataaggagttctgatgattaaggtattttacgataagacaagcacggacaaggccaaagagtttgtacaccaggttaactgtatcgcatgggttcgccataaccaccctgagatatttgcatggcacgtgaagaatgaaggcttaaagtcaatcggcactgcagtgaaggataagcaggagggcgtaatcaagggagtgtcggatatattactgatcgggccaaaaggatttggagcaatagaacttaagcgagcaataaaatcagatagcaaagtttcgaaggagcaaaaggagtttcttgaaaaggtatcagaaacaggcggttacgcagcaatctgctacggattcgaaatgtttaaactggcaattgaggattatctatcaaatagcacgaattgctaaagacgaaaaccaaggatggtgtattatcacttcatcgaaacgaaacgcacaaatgaggcaaacaaaatgaaaaagttaattatcgcaactatcctgatggcggcagcaagtgttaatgcagacgcgaaagctaacaactgtcatgacatcgttcagtacgcttacaaccttgcagttaacgaatggggcgctaacaaaactgatgtggttaatgctaaaactgtcagtctctacctggatacatgtgaaattgctatcaaatcacgaggcacttacactaaagatgaacttacagctaagtatgattcagtaaaaacaagcactaaatcagagatggatgttcaggatattgtaatccttgtatctagaatctcttacgataaggcataattttatgaaactttctttagaaacaaagtgggaactgttccagggattagcagcaaagaagctggttgataacggatttaatcaagatccttttgaaatggctagcagtctagatatgagctttgaagaagattacttgcacgctgatttagaggattgggaagatatgatgcaaggtaacattgaagagtttaaagaggatgtgcctgaactttttgcggagattcactaatgagtgaggaacttaaagtattctataaagcctatgccgcttggcttgacgctggcgctgttaacaagggtgcattctggcgtgactgtggtttgtgtacgtgtatcgtgtcttggacgaacgacgatgaaggttatgagttactgaatgaaatgaaatcgcagtttaccgccgctggtctgagcgatcgattcccgttcaacgttagcgacgaggattacgcccgggagcatctcaatagcgccatgcaccttaacgaagaccgcgtagcctgggtacgcaaacatgtggagatccactaatgaagattgatagaaagcaattctcaaaagctcaaattaacgcatggattgcaacgcagtttaataactcagaacattggattaaagcaatcgaacagcttaggtgtgcttatgatactaaaaaccggaagggctgaggtctggaagcactgcggagaggctggactacaggatgatatcaagataataagtaagtactttgacattgatgatatctctgtagtttatgatggaaaattcagctatatgaaccagcgccctcgaaagtatgtaagagttccggcaaccccaagccttgcgatgtatcgcgaggaaggtaagaagatatttaagaaaggtgctaagaaatgaatttacctggacttgattttgatgagagtaagtatccagttgtcttttttggtgagaagccttaccggaagatcccttttgctgattggattccaccagactatcttgatgtgctggttcagattgaagttggtaaggctgaactcatgtattactcaccaggctgcaacatgatgatgcctagtgaatactctccggcaatagccgcgcttgaaactgagtttcttgattactggctaaaagaagttaaatagcactttttgttaaaacgcaccgccaaggatggcgtatagtgtgttcatcgaaacgagagaagctttagatgaaaacattactaccgttgatggctatgccattaacctttataatcatgtacttcataatctgctaacaggaaattaaataatggctattgctaaaattacgaacgaacaacttaaagaagaactagctaacggtatgactaacaaatcaatcgcagagaagtacggtatgaatattcgtaacgtagaactgcgtcgcagcaagctggctaaggctggggatggtcacggtcgcgatgttagtaacctaattcctcaaggctacatggttaagggtgtatctagcctcgttgataatgatggaaatgtaaagttgcagtgggttaagtcctccattgatgcagaaaagcttgaagagattatgaatcaagcgcgagaggcattttctagtgagttaccaaaagaaaaagcagtgaagtctgaaggtctggattttgatgaagatactttagccatgtatccagtgtttgaccttcatattggcgcgatggctcataagcatgagtgtggagaaaactacgacacagcaacagctgagaaagtaatgaatgactactttgattacgctgttcagaaagctccaaattcaaagaatgcggtactagttcttggaggagatttacttcactatgattctctagaggctaaaactccagctagtggtcacatccttgatagtgacagtcgctacgctaaaattgtttatgtttgcatacgttcggttcgtcgtgcaattagaaacatgcttagcaaacatgaaaatgtagaggttaaagttatatccgggaatcatgatgaaagtggtatggtttggttgcgagctgcacttgcggcattttatgaggaagaaccacgcgtaagtattgatgttagccccgcggcaatgatggtaactaagtttggttctacaatgctcgggttcactcacggccatcaaatgcggaaagctgatactcgccttacggttatggctactgactggcgacgtgactttggcttaagtgattatgtatacacccactcaggccactggcattcacagaagattacagaaacaaatcttggtattgatgaggttcatggtcagcttggttcaccagatgcatatagtgcgaatggtggatggcgctcacaaaggcaggctgcggtaatcatatatcataaagagtttggtgaagttggtcgctttatctgtcgccctgaaatgtttaaataatagcactttttgctaaagccctccggggcttttgaaaggtgtcaattacagactgaggaatcaaaaatgattacagagatgattttagttgcaagcctgtcgtctccattggcatctcatcagtattgtgagcttggcaaagagatttatcacgatggagtggaagtaaacacagttgttgagtggctaaatcacagtacgatgaacattgatgataagaaggttgtccttgagtgctatctggtggaggcaaataaagtttaaatagcacgaattgctaaaacacaaattaaaagattgggtatagttactccatcgaaacaaacgagaggatacaaatatggctaagttcacacaatcagatgcacaaatcgaagttaaagatgttggttttggtaaggcattcaagattgcgcaggcgtacgggtctagcgaagaagatgtgaaagttgacactattaaccttactgctaagaatgcacgtgagatcgcttatgcaatccttgcagcacttggagaaaaatgaaatgactaaattattttgcgtaatcaacaaatcaaaaactctgccgttcactgtaaacaatccgtatagcgctgagtatcagggtgaaggaaactacaagatttatggcgatgacatgacatggatttttgcgccaatcgatggagctttgttggaattcattatcgcagactaagttattaaaaacattaacttgcaaataggcggcctttaaggctgccttttttcgtttatgtcaaaggctaatgtctggtattatttaaccaaatcaactaaacaaggccgcaacatgaaacatttctatgacgcagccgccttgtccggtagcggagtagctatgggcggcggtttatctgacaacacaatcatcggcattatcggattagttatcgccgtatgctttggtatttttggcgcatggctgcgctggcgtgacagtaaagcgctccataaggcacttgaagatggagacatccgagaggcaatgagaatcaggagcaaatgatgagcatcaaaaataaggtaattggttcggcagtagctggtgccatggcgttagcggttccgttccttaatgagcatgaaggcgttgagtacaagccttacagagatattgctggggtatggaccacatgcgctggaattactggtcctgacgttattctaggtaaggtttatactaagaaagagtgtgacgcgcttcttgcaaagcacttagcaattcatcagcgcgctgttgataaagctctgaatgttaatgttccagttagcaccagggcggcactgtacagtttttcattcaatgtgggaaccagtgcaatgcgcaactcgactgttattaggcgcatgaatcgtggcgatatccgcggaggatgcgaggcgctatctatgtggaataaaattagcgttggtggcaagaaggttgttagtaaaggcctggttaacaggcgtaacgcggagattaaactatgcgtctcggaattgtaattattgcaactgtattactgactggttgctctggcctatcggctatttctgattttttaccagcaaaggatggcgtcgaggcaacagcgcaggtgggtgaatctaaccagaaaacaggggttgggctatcaaatcagacagacaaatctagctctatagaaagcgatatgcgcaactcaactaacagagacgtggactcatcaagccagaaaaagaccgccgctactggcctatcagctaacacaataacggctgaaaagattgaaattcatagtactgaaaactcaggggtagattcattagtctggggtattcttgccgggctagtttcttgtttgttaacttacttcactttaagatttgcaggaaacaaaaaaggagcctaatggctcctttctctattaataatcatcctcctcgaggttgtcaccctcatacactaaaaagaacccaagcctttgtaattcagctcccgccatgaagtaacccaacgcttcggctcgctctgagtcattttttaaaccatctaaagggtatctctcataaaatttattaatcaacatagcttggtcaaacttgcttgaattgtattctttcatttaaataattcctcgtctgtcatttcttttatcgtcatcatctcattggtgtacttatcactctcaccattaaggcatctgaagctaaatccgaatggtcgcttcatgcttcctttactccagtaattaccattaactccatcgatgtaaccttcagtcatacatcttgccagaaactcctttgacgcggatgatgcaaagtaacgcgtagtaactccagccgctttagccattctttcacagtctttatggcggtaaatgaacaccgccagatgctgcctgttaaatctctcgtagctctcgcagaacttgaacacatctagtaaaaacataaatcacccataaattaatgataatatgcaaaacaaaatactcatcaaatgaataggaattagagagtacatgacaaaattttcaacctttctcataaatcaccccagcagtcgtggattaatgtaaaccttatcaccaatcaggcaggtgtagtttttctcatcaagcatcggaagtaaatggtctttaatcttagccattacgccagcctgagcctcaaacggtctaaccttacgtgccgcttcatagagtgatcgcaaccccaccactcctttactgttctttccttgcttaataagaatatcaattagcttgttcatctctgcattatcaccagcgtgaccagcagcattagcggaagacaagtaagtcttactcagttcttcaaacataagaagagcttcttgcatcgtttcaagcccaatctccctggacttctgcggactccctccgtttggattaaaccagttacggatagtgtgaagaactgccgctatcctgattacctgcttatccattttacctaacgctccgcgcaacattgtgtgcgagtacttaccgccatctgcaaggtgcggctccatttcctgacgagcacggttgaggtgcttcattgctgaattactgacagttagttttacatcttgctcgctcattatttcatgaacaagacgaaagtaatctgcctttaatccaccatcaattggtttatatgttgactcgccctcatcatcaacaaacacacgctcaccaaggaatgacttctcgcgcacaagaaggaaacgctctgatacaccgataccgcgagcgccagcattcatgattgcgacgattgtttcatcctgcgcaattacagaaatgcaacccatagcaataaagctcatgttgttctctgcgttcgcacgcgcgatagatacgttaccagcatcccaggccttcagaacaagttcgctgttagttttcttcgagccatcaccgtaagtcataccaagaagtgagttaacacttgtcgcttcatcagaaatcacggagaagttgccctggcggttgttgattcgcgcaagaccttccggggtagtatcagataccggaaacacaatgtcgcacagcttttctaacttctcttccaactcctctttatcttcgaataatccagccatctcagatggtgacttctcttgcttcatttcttttgccagggctgacaatttagccataatcttcttacggtcacgcttgcgtaattcgttcaatcgctcagtctcagcaatcattggcgctagtgcgagtgagttaatagctgacttaccagttgatggaggctgactggttactacgtacagcgcggtaggctgctgagttccatgatactcaaccgtaaagcgaccaagcattgctgctgaaatacacccaaggaagtgcatgtaagctgaagactctgggaactgaactgagcgtgcgatattgcttgataatttaccaacgacatcacaatcatttcctagcgagatgaccggatatttgtcaccagttgaatcaatttctaccggagccttccagaatgatgcactctgtcgataaccattggcattaatagcaactcgcaatggtggtaaattttcagctgccgcaacagacattacttgttcgactgataatttatcttcgttaaaatcaaacatcttattctctctatttgttatcgatgggtataaatatacccgccgaagcgggtagtgtcattaacaaaaagtgctatttacttatactgagcttcaaacttatacatcccataaccaacatcatagccaacttcatcatcgcgagtaagttgccagccgtcaccttcgttgtcgtagatgtagccagcattacgacctaatccagcgtgcatggagacctggtaacgcttaccttcagtaaatgatttcttgagcggattgctgtggtcaaccctggtgcacagtagtgtctttgtcttaatgtagtgaccgttcatgtctatattaacccatttgccatcgaccttaatttgttcaactccatcttttgctcgagctttaaataatttgttatcgctgcttacccagttctttgtgatggtagtggccattattactttccttttatgcgtgtcatttcagtgatttcaatatacatcataagccccgaagggctttaacaattagtgctatttctttgctgcttttgcaattgctttctgaacaatgtcgaaactctcaatcaaatcttctttaaagtagtcaccaacaggccagcccttgccgctgtactttgctatggtttctagatcgtaatagttcaaatcagatggcttaagcatttatctcacctcatcaaaagtggcgattccagggatgaacataccaaccttccagccagctatagcaatccaccccgaatcgtgcttgtgcggacgctcagcgccattaatcacccattcgttcgggattgtcttaccgttaatgataagcggctcagcgtcgtatacagagtcttttacgaacggtgttaaaaccttcttatccgtgctttggataacgttagtgcagcgaatcttcatgctaatacctcgatttcttcttccgtaacgctgaattcttcaccttcataaacagccgtgatgccatcaattacaacatcgcgcttcgcatcaatgaagtactcaccttcaagttcaaacacctcaacctcttcaccaacttcatagcccatctcagccaggcttaatgcatcttcgtcaaacttgatttcgttgttgataataatcgctttcatctgatatctcctcgttgtcgatgtgataactataaccaatcagggctgaatggtcattagcaaaaagtgctattcgttcgatttatggattgttgcagatattgcaatgattcacttcactattgcatgtatagcaatattgcatcgattgcaatgattttctggactgttgcgaaatttgcaatgattgatggattgatggaatgaaggagggcgcatcaactagttggttggttttagcttacacgaggagctttcctttatatacgcgttatggcttgttcaaccgtgtggagaaattgccatatttacgccatccacgccagtttacgcgctggttacaaaataaatcccttatataacaaccttttagatttattattattattattattatatatgttatcccgtaaccatgattatccaagatattggtgatatttttttgatattgcgcggcgcataaagatttagataaagagatagggatgcaagtggggtggagaaaatggcttaacagaccataacggcaataacagccttgatatgactagcgtcagcatgtaacaatttagcataacgtgcgattactgagttgaacgtgtaaataatgcttgcgacattcacccatcatggtaagatgctctcacactaaacgagaggagtagtaaaaatgagtaatacaattcgtgaagcaaacccgacacttggcgacctggtgcgccaccttgttaagatggcactcaattcagaggatggaagcgtaacagttcccgttaagttgctttacaagaatctttacggagaaattgataacggctatgtagcagccgactttagacctggcggcaaatattcacttccaaagcttaaggcttcctatgtttcaaatacagccagtagaatgcaggaagttaaagacgcagataagcgcgcaaggttctcttgtggagagatggattataatggtgatgagcattattgcgtaaaaatcacaatggtcgacggagctgttaagaatggaacccgagctaagacaagcagtcaattagaggagaaagcggtaagcgagtttaaagccaggctacttaagctttcccctagcgttgcaggcatgagtggtgatgaacttaagggcgcggtaactatgattaacgcatatcaggaaatgattaaggagactaaataatgtttgatttcaaagaggataaacttacttatgagcaggtgttagcagcagcagcggcagacaatctgcctcccttgcgagtatcaataattgcaaatggttaccgacaatctgcaaatctatggcctgaactggataaggtcaaagatttcgaactagacactggagctttaaagattatagaaatcctcattaatcaaggaatgagcagtaaaggtgtcgttggtctcgggtcactatataatacagtaaggaaagttaaaccattcgaaggtaaaagtgaagtaattatggatatcagagatgtcatcatcccaaaccttgataagcttggctatgcatgcctaatcggagataagatttacatcaaccctaaactgcttgatggcaaccaggactggacttacaaggttaagctgctggaagatgatttcaacatcgacgattgcgagaagattgttgacgagattactatcaaggcaattgatgagcaaatcgagaggctcaagcggaagaagaagtacctcctgaccggtaaatagcacgaattgctaaaccagttccgcagggatgcgttatagttatttcatcgaaacgaaatggttaatagaggaaggcaaatgagttattacgaagttatcgacactggcaataaatcattacttggctcaaagcgctttaaatgtaccggccaagggttcactggatacggctttgacgagaaagatgccatcctggaatggaaagaagctaaatacattggggagttcgacgaatgaaacacattggatggctggtaaacggaacgttctactcactaaccgacgcagtaagggtggaaagaattagagttaactgcggacgaaatgtccagattcttgaaatttacgcagaggaggaagtatgcgtaaggtactgatgatatgcgtctatgttgccatattcttattggcaaacctcctggtagcctcatttggtccagcggtaactccatttaacgcactttttcttatagcggcagacatggtattaagggacaggattcagtttgagagcggtgcggcatggtcaatactagcatgcttccttgccggatttgcgactgtattaatagcgccaggttcagagatgattgctttagcatctggcctatcatgcttacttgctggatcagcttcagcgattgcattcaaattaaagtctggtggattttttcagaaggcgttgccagcaaacgtaattgctgctgcggtagattcaattgcattcccattaattgctttcgggtctataatgccaggcataacagcagcccagtttgccgctaaaactattggcgcatcaatcatactattaatcataaggaaattatctaagtgacaattcacttccatggctcccctataacggggggcaagggcgatgcacttgctcggaccgcgtatacaaatggcggtgctttcgtgtcattcgcccacccgcagcagatagaattggcgtttaaggtagcgaatgcagtatgcatagataatggtgcgttctctaagaagaatagcggcaaagctactgactggcataaattctataatgactttttacccagatttatcgacagagaaaagttacgattctttgttatacctgatgatatcagcgggtgcgacaaagagaacgacagattaataagcgaacttccattacacctaaagcacaaaggagctccagtctggcatatgcatgagagcttagacaggctagtccaccttgccaacgagtgggaatacatgtgtataggctcgtcaggcgagtactactctatccgttcagagaaatggaagcggcgcatgaatgatgcctttaacgctctaattcagaggggctactcagcaaaaattcacggcctcagaatgctggatggtcgagttcttggcaactacccactggatcaggctgactcaacaaacctggctattaatgcgcctaagtggatatgcaaatatatagatatgaccattgaggcgtgccgagctcagactcacagagacgcatggatttcaacctcagatccgaagtttgcacttgagcaattaatcgcagacggcggcacaagggagcagatgctggcacagagatgcgcgatactcaggaattgcatagaagcagtaaggccaccatcaagggattcatggaatagcacgaattgctaaacaataaatcgggtagtcagctatgattaccctatcaacaacgaagaggaaatgattatggatactggaattttacgcattgacgatgttcactttgaccaggctgaggtcagtgtcaccaagttaacctttcgaggtaatgttgttagccttgacttcgatcctgacgactacggcgacggtcaaacacttatgcaatactcacctgttgcggcccgcaaattagcggcggcattaatcctggcggcagaagaggcggaagagcaatgattaccattaacctgtcttatgaacaagctgcagagctaaaagatataatgcagcactcactcattaacaagaattatagctgcacagaggtgctatcagaagcgattacacagattcagaaccaacagatagctgacgatgatgaactcccatgggacactgataccgcctggagccgatacgagcagatttgcacagcgctatcaggttgtcagctggctagccaatacaaatgacaatatacgaacacaaattcagtagcaggggtattgatatgctcctgcattatgtagacgagagatacgccatgttgatgcagaagacgcatggcggcacaataacgaggattgagatatgaagattcataatggcgaatacagtaatttttacattgatgagtgcgttgaactatatgaaggatatggcgagccaactgcgtgccatggagatgagcttggtatcagctttcccgaagagcgtgaggattgatatatgagcaagtacaaccgagagattatcggcctggatggaacgttaacgacagtcgatgtatatcgtgttctggatgcattccaggtaacagacccagcaattcagcacgcaatcaagaaaatgctctgtactgggttgcgaggccacaaggattacctcaccgacattgatgactcaatagaatcacttaggaaagcaaaggagctttacggtcagaagaagataaatagcacgaattgctaaacatcaatcgcagggatgcgttactattactaaatcgaaacgaactaggaagaagaaatgaaaattaaaattatcgatgttgattatgttactgatgacgagtctatcacgcttcgcgaatgcggcttcgagattggcgatgttgtagaggtgtctggtaagtacaacaacggagagctttcaatccaggcaatccgtgagactgattttgttaatgttggcaatgaggttagtataagcgaatttgaatatgaggtagtggaagaatgaaaccctctgagtggtgcaaaaagatgatggatgaggcaaaagacggcgaggaggcgatgacatactttgagttgatgaatatgtggcgtgagcgcgaggagaagaaatcgtgatttggattcacacgtactatactggcaagttcaatagcgtaatgcacaagaggatgtatgacagctatgaagcagcaaaagcacaacacgcagttctcggtggcgacattcaatcttacaagaaggcttaattatgttcggacttactcaaccgcaattcaatgcagtgcgcgcccaggctaagaagctaaacgaggcagtggataagctaacagccaagcagaagcaggataacgatatcatgaaggcagttatctgtgagttccatagcccggtcagtacaatcatcgagaagatgcggttcgtctgggttgctggttatctggctggccgcgttggtaagcgtgaagatgggagtaatatctatgattaatccattcaagagtttcgctgtttctatgggatggacttgcaggaagcatgtattcgtactctttaggcatatcaagtggtatgagattgagtactaccgcaaaggatatagaagtaagctggtatgtcgcaattgcaataaaatgatttactctaagattgattttaatgataaatttggattgccactatgactgaactatcaatatggttcctggctggcatgctgacttggatttatttcgtggtcatggcttgactcaaatgtttaatatggttagtattaaacacgtagacggcaatgaccgtaacgcgcatcgcggagatgaaagccgatagccgggctggataaagatacgaggcaactaccgcatcgccaaaagcaaagtgtaagtcggacttgcggagcattgtgaaagctcgccggattccgtaaccggcacctattcaagttctgttagtgtaagtggacagcacgaagacctcctaagtcttaggtactggttcaagtccagtgcggaacgccaaatatgctcacgttgctaatgttggcctaagggtggagcttatacctccataaagcaatcaccagataagtgatgtaacgcaggttcgattcctgccgtgagcaccaatcatggagcatcctagtgaataactacgaagtccgtttaacttcccgcctaatgggcaggcaatgcaaatcttgccagcaatcctacgaaggtaggttccctgctaacagccctgaagaagcagttgcagccgcaaaggcagcatttaagattgacctgacggttcacaaagtcagcgttgataaagtatccctcgtttgagattggtaatctcgcaatgtagtgtttcgccctcctcgtgagggctttttttcgtctctactcatggtacaatgacttttaaaacaggaggaatgacaatgacaggctatcaaccaaaaccacacgatggcgaaataaaaccaccgccaaggagaccttgatgattgagtctatagcatcaatatttggggttattgtcggatttactataatttacaacatctggaagattaggagttaagctatgtcagaagagaaaaagattcaccagaagatagggaacttcaaggagctctataataagaagtatggcgacattgccaatctgaaaattaaccacaagttcacgccagagcaggtgttcgatttggctgttaagtacttcacgtgggcagaagaacaagcaatcaaagcaattgagacggccagcttccagggtatcgtaactgagaaccttattcacaagccgcgagtatttacgataactgggttccagctgttctgcggcgtaggtcataatgctatcagcaagtggcgctcatcgcctgggttcgatgaggtcatggagttcgttgactcggtcatctttgagcagaagtatcagctgggtgttaacaacatcgtcaaccccggactgattggcaaagaccttggcatcgataagccgcaagaggttaacatcaacaatgcttctaatgccgtggtaaacgatgaggaagcaatgaaggccgccctgacttcggtaatggaaaaactatgaaaatactaaaatctatactggcatactacgtcctttcttgcatggcattcactagcggctttcttattggtgtaattattggagcaataaaaaatct

SEQ ID NO: 5 - DNA, 81878 bp, Unknown
  bacteriophage genomic DNA
  misc_feature (574)..(621): n is a, c, g, or t
ggtttttctccaaataagtttcgataattttctgggcgagataaactgcgttatcttcggacgtcataagaatagctatggaacgctcgtcccctacttggtccagattcaaccaaacgttttctttcttagtctggcctaaagctacatacatcacttcaacggtcttttcttcaacctcaaccaggaaatttctgacccgtggggaccaccagttcctcaaaccggaagaatactttttaaagaaccgccttgatttaagcgttttaaaacatcaagacctttcatatcatatttgacttgcataacattttctcaaaggttgcgatactgttagctgggccacttagagttatctctatgaacccaggctgacttgaaggaccaattctgtatatacatatggctaatgttctttgcgtatggacgatcatcagcttaaagaacgaaaagttccaggccacgtttacatcaacagcttgaaagatgctcgccgtatgctttctgctttaattgctgacggatgcagtattgcttataagggtgcgcattcatatcattattcatcaatttnnnnnnnnnnnnnnnnnnnnnnnnnnnnnnnnnnnnnnnnnnnnnnnngtgtccttcgcattcatatcattattcatcaatttcattgaataatttgacttctgaagttcgaaaagaaggcgaaggacaccgttattcaatgggtcattggttctgtggagctattgaagttcactacaatactcgtggtggaaagtttattttctcatttattgccgataataatcttgaagaagctcaatcattccgtggcccatcacgagaatatcttgttaagcatttttcagctgaaatgaataatcttgtagaaaagctacaggttcctggaagccatatcggagcggacgtttccgatttcattaactactgccgtgggcagattgcaaagagaacaagaaatgaacaaagtaattcagattgaaattcctgaatataacgaccgtaaatctgctgcagcagctattgcaaaacttctggagcagtcagaagaaattgaacaagctgctgaagttatcgctgatgagcattgtttgacttttgatgtaggtgattatggaaacggccgtacttattatccagtaggctatgacgctcattggcttgtaggtcatcatggtgtagaagttgatgaaaatgaaaaacttgtagaaggcgtttggctttcttcctctgatatgtgctaaggtaaattatgactaaaactcgtgaagaaaaacgtaaagaaatcgaagaagttgcagttgaagtagctaaacttcttggtaaacttgaaactatggcgaatgaagcttcttttggcatggaagtttctggtggatatctgacctttaacgattggcagtcttctgattgctatggcgaaggtaactctgagacctttggggttaacgaggacggctctgtgtggtatactagcagctgttaatggtaatatatggggagactgaaaagtttccccagaatcactggaggaacactatgaaaggcttaaatcctaattactgctatatcattgaccattatttttactatccgaacaaatatggaagccatgatagttgttgtctttctgcactcatgaatgttgtaatttgcaatggaaaacttaataccggaatcagagaagctgctggcgacatcataattcaactcagtgaaagagaacatccatgggattctcttcctgaccaaatctttgacttgctaggtggttggaattggaaagaatgttatccaattaagaccccagaagaacctattgaaaatttcataagaatttgtagaaagaaccagagaaagaaccgtttacaacagaagtcaagtgtgttatagtagttctacagtctaaagaggaaaatattatgttgctggttattggttctcgagcactacatcaccatggtctaattgagtatagtgatgttaagaactctgattgggacttcattgcgtccccaggcgaatggcttcatttcaaaaaccgtatgaacggcacagaggttgaagttcaatctcctaatgtacaagctttcaaatgcatgcacaacggtcgtgagacctattttgaagcatacatttttgaatataacgacgagagttcatctgaactgcttgctcattacgcagtatttaatggatgctatgatgcgctttcacagatgtattgggcaactcctgagatgtgcttagcaattaagatgtctcatcgtttcaagaagaacactcgtttctttcaaaagaccatgcaccatattcgtttcttgcgtaataaaggaattgttttagacagtaaactgaaaaagatttctgaactgcgtcagaaagaaacattagcatattctcatcctaatctggatgtagataaagattctttctttaaagatgatttttacatctatgaccacgattcaattcatgaagcagtggctttagctggtcgtcctgcttatactttttacatgaaagatggctctgaagtaatgacttcaaaagagaaatttgattctcttcctgaagaactcaagcttgcaggtgtatatgaagaaacttgtgtacttgctttagaacgtcatcaaattccaaataatttcaacccggaccctaccggttcattcatgtacgctttggaaaaagtttgtactagcattacatctggatggttccgtgaatatgcatgggaaaactaccataagatagttgcaatgcataagaaacttggaaagacagattatgtcaaacgctttaaacaaaactttgacatgattcgtccattcaaatgataaagggccttcgggccctatgaggaaaataaaatgaattcaaatgaacttaaagctaaaattgctaagacagattctctttcaacaaaagtcagatatattttgactagaaatgaaaagctctgctgggtcataggattgtcaatatacgcaattattttgtttttgggctggtctgatatcacaaatcttccaaaagaagaaagagctgactctgctggagcaatggctgcgttcacatgctttggttggggaatgtttgcaatcatagttatgctgattggcgaatttgttaattttattgctcaaaatttaatttgcatgcaaagaaatagaatagtgtcaaagcttggtaaagctgaacggtttgaaagctttattgacgattgccgtagagcgaggaaatgatcatgggatatcaaccaagaagtgaattaagagaatttgaatataaagtagacttttggcacatgatggtaattttagcttttagttcagtaatagtgcttataatttttattccagctttgatactaaatgatggagtttatgctccaatttgggttgtaatatcaatgcttatttctattccagttttaatttggtcacatggaaaatctaacgacatcgcaatttggtgggtgatgcgaccagaaaataaacgtttagctgaacagaatgctaaagttcttcgtaatagaataattcgagaatcagaagaattcattacggaatgccgaggtaaaaaatgaaatacaatcctaaaatgaatatcagacattttgaacgagaaattgaagatagattcaagtcgaaatacgaagacgacgtttgttgggcaattattatacttactgtcttcatatcaaatttcgtagtttggtggttcaatggatttgtagctgaaatgattatctctgtaccactaagcgcattatgttcactattcgttgtcattgttgttgcttcttttattaagtggtgttattgtaaaattcatgttaaattgtttactaaagccaaagctgcttatgataacaaacaaaatttagagaattttatttcaaaatgtaggactaaacgatgattaaaacattatttcgcggattccaagacgctggttcatatgataatttcggatgggccgcttgtacaataattatttgctttatgttcacaatgctttatggatttggaacatattggggattgtacttctttagtcctttgtatggtgaacaattactttttgttggctggatgtctggcattttaactccattctactgggttggaaagtggctattttatcttgggcaggttcaacgtggaacttttgaccaaaaacgagaatggaaactttttaaacggaaatctaagcctaaagaaattccaccaggtgaagatgctttaaatttcattcaaggtattagaggtgaacgatgagttgtccagctacaatttttacttcgcttaatggcgaaatcaatggttcagtccatcacaattggggatggattcctccatccgattatgaagttgcggttaaagttttacgtatcgttgaaaatgttccaggagaaatgcgcaacggccagttagctgctaaatgggataagctttacattccaccgtttggtaatatgctaaaagaaaagtactgggatatgtacgatacactgaagaacattcactatggtctgatggaccgtaaagattttaaactgtctgacttcttagaggaaaaggtatgagtattgcagtatttgtaaaatctgaatcagctgattcttacttgtactcttttaatgataacgagtcagttgatgatattcgtaatcgtctgtcaacggacctggaaatgttcactccaattagtgattggatggtagaaggttcatttgactgcgatgaagatacgattgaagaagttgagtcaatcatgcaaagacttcgtgaaattagttggggtgaaatttgagtaagaaaattaaagaagtctctgctggcattctgttctttacaaaagacaaagaactgttcatgggtcgagtaactaattccggactaggcggtgggccatctcgttgggatattccaaagggtcatattgaacctggtgaatctcccctcgaagctgctgttcgcgagtgtcgagaagaaagtggattcgtcgattataatccaggacatctagtggacctaggccgccatgattatgctagcaataaagatatacatatctttgaatatccgttcccagtggaacactctcaattcagagattgtatttgcacggcatatcatacagatgaagacggaaatgaattcccggagattgatgcttttgctttgattcatccacgcatgtggaatgtagtaatgggtccaagtcttttctcagttatgcagaaactttatccaaaggtcattcaagatgctctttgggaatgctaaataaatactcctatcaactgataggaggtcctcatggacatttttggcatgcttcgtatcgatgaaggatacgattctaaaatctataaagataccgaaggtttttggacaatcggtattggtcaccttttgacacgtgacccttctcttgatgttgctaaacgagaacttgataagcttgtggggcgtccatgtaatggtcaaatcacaaaagctgaagcagaagctatttttgcgaaagacgtcgataaagcaactcgagggattctcggaaatgctgtattaaaaccagtatatgatgtacttgatggagttcgtcgtgctgcacttattaatatggtgtttcagatgggcgtaacaggtgtagctggtttcccagcatcaatgcgtctgcttaaatcaaaacaatgggaagcagctgcaaaagagcttgctaattccaagtggtatcgtcagacaccaaatcgtgctaaacgagtaattgaaacattccgagttggaacatggaaagcatatgaaaacctataatgaatttttaaatgaagcagctgaacaaaagcgagttccaggtggttatatctggattgaagaaattaagcctggcgaagatatgggaacttacaaagtgaccattgacgaccctaaaggaaaaggtcgaattactttgaaagataacattgctggttataaggctgctcgaacagtcgcgaccggtcacatgcgcaaaattatggttgataacccttccaataaatttgcagctaaagtgttccgtcgtattggtaataagcttcacgacccgtttagttaacagtttacatcttaaagattttgtgatatgatgtcctcctaaaccaacggaggacactatgactcgcattaatcttacactcgtttctgaactagccgaccagcatctcattgctgaataccgcgagcttccacgagtttttggagctgttcgtaggcatgttgctaatggtaaaaaggtctggcagtttaagatttctgaacactttattcttggttcaggccatgtaacgttcttttataacaaacttgaatttcttcgtaagcgacaagaagctatcattgctgaatgtttgaaacgaggtttcaatataaaagacacaacagttgatattagtgacattccgcccgagtggtgcaatgactatattccaactgaccgtgctattcgtttgtctcaagaacgtttaaacgagaaaattgctcaacgccctgagtggtacaagcattatggagtagctatctactcttaaaaagccaacctggacctctcctcatgaacgtcgtgtcctctgagtgaagtagcttctggtacctgtgaaaaggtcgagcccaagtgcggtaaagccagttacaatcagggtcctagcactcccgctagctgatggaaattcttgagccatggaaggccctcactaacggtaaacaaaatgaaaataaaatctctatttgccccatatctatccctgatgcacgcattcaaaatccgtgctgatgattgtatagaaatcctcaaagaaagtcattacactcctatagatattctacgcgaatatgctacgctaaaaatcgatggcggacgtcaatcaggcaagactaaagctgttgccgaatttgcagcagattggttacatgatggcggaactgtatggattattagcactcatcaacgaaattcagaagaaaccgcaaaacgaataagagcttgttatgagaaagaactcattcatcaagcaaatccagatgaagccaaacgcatgattatcatggacactgtgcgaagttttctgagcgatggtggttcaaaggcccgcggtcgaaagcttaacagaatcttgtatattatagaagaaccaatgaaactccctgaaatggaaaaattctatgaagcccatttcaaaggtccgttttatgcatgtgttcatcaatcacacgttactggtgaagagatgattccattattctttgtgataggaatgcaatgatgaaagaaaattttaataagggccttttggcccttgatatgaccattggtgaatatattcgctttttgcgttctactggaaaatgcaatgtagagtctttgattaatattctacatatcaagttttcagatggcgcagttcttgagccaaagctgtatcgatttttagatgggccttttaaaggctcgttgttcctctgcacttcgccagatgtgggtctgatgaatgagcatccatggtttgaagtagagtttatctctggcccatgcaaaggcattaaaacttcaagcttaattacttacgaccgcaaggtcatttctttggagccaacatggcgcaaattattatcgacatccccgaccacctggttgaatctttctgcggctggttttcaaaccaaggcgaacaggatttaatggaagcgcatgctaacggtgtgtggaatgaagaaaccaaacagtgggaagacgctaaaactggtcttactgtaagtggttacggaattaatgaaccaatcaaaattcgtgagtatgataaagagactgacgaagaaattcaatacccataaggaactactatgaacgcatatcaaattttgaacggcactcataaaggcacaatttatcttgaagatggtgataaagcccgtgtgattgtatctaaaactttgccagaagattctatagttgatgtagaaactttctttggttttgaatctcgtgaaattggaattgaaaccaagcctacagttaaagttgaaggtggacagcatttgaacgtgaacgtgctgtctaaagaaactttagaagatgcagttcaacatccagaaaaatatcctcagctgactattcgtgtttctggctatgccgttcgttttaatgctctaactccagagcaacagcgcgacgttatttcacgtactttcactaaggaaatgtaatgtcaattgaagatatcaaaggttacaagccgcacactgatgacaaaattggtaaagtgaatgctattaaagatgctgaagttcgtctcggcttgatttttaaagctcttgaagaagagcatgtaaaagtatacatggatttagatgttgataaaattagtgatgaagagtttgatttagcccatgagcgtatcactcaaattcgtaatgctattcaacacctgaaagaagcatctatgtgggcatgccgttcagtgtttcaaccggaagaaaagtactaatgtctatccgcaacaaagtctctgagtctttctctgaagctatcaatgctatggaagaaaagatggagcagcttgtggatgagtctatgggtcttcatgaccctaagacttctgatgctttcaatgctgttcaggacaaaatctccaagctccgtcaacgcatcgcggacaccaagaagctgcgtagcaatattctgcttcaagtgttctacgatgaccataactactgactatttactttctccaagggctatgatactatagccctatcaacaaaggagattgaaaatgacaactaacccagaagtattcatccgccgaaacaagctgcgtcgtcgctttgagactgaattcaagagtgtaaacgattctatacgtagtgcttgcgcatctgctggtattccagctttctttattaaatattctaatcacctcctggaccgtgctatccagagagaaattgatgaagagtatgtgttcgctctgttccacaaagtacacaaccatgtaacagaaattcacgagttcttagaaatgccgatgcttccaattgacccatcggaaattgacccagaagtagagtacagacctcaacgtctggaaatcacagatggtactctatggcttggaatgactgtctctctaccaaacccagaacatccgttccgcggtcactccatgcaatgtcgcatggcattcgtaaatgataaacgcttgaaaggtaaaatcagcacaaagattatcaagttatagctttaatttgaggtaaacatgaaaaaagctctatgcgcggcgttactcctagtttcgtctctaggattcgcgtccgaacacaccttcagtaatgtccaactcgacaatttgcaatacgcatattcgtttggtgaacaatttcagaagaatgggaagtataaagaccatagtaagcgctatgacaatgatggacttggttacattatggctgcactagtctggcaggaaagttctgcaggcttacgtacaactggtaaacatgggcatcaagcttacgggatatttcaaaattatcttcctacacttagggaaagagttaaacaagccggatggtcaatgacagacgctgaaatcatccgcatggcaaagagccggaagcactccgccgcttgggcgtatattgagttaagttattggttagaccgtcataacggtgatatgagaaaagccatagcatcatacaacgcaggaaacaagtggaaagccggcaacaagtacgcctctgaggtattagcaaaggcgaattacttgaaatctcgtaaaatacttcattatacggtggaataatgaaaaagttgtttgtacttctaatagtttttgctctatctgggtgtaaagttgattttgctactgaacaagatgattctttagtattagcaaagcaattctgcactaagactaatacagagtgtttgaacattttgtcatttgactttgacaaaacttatgctgaaggacaaactgattctggtagccgctttaaatggtctaccttggtggctcgtaaggctaaagaccttgagtcgttgtgtgataatgcacctgatgtaaacgtatgcgaagaatatcgtgatacgttattgagggtgtatatagcgggattatctaagtgaaaatagcagcatttctgctagctctaccattatcggtaaatgcctgggaaaaactcccaggctatcctgataatatctacgctattgatggtaagctagttgaaacaacaggttcgtttaaaaagaatattgaagtttcttactatcctaaaaagaaagcttttggtgtatcattttacaattattctaataaagaagaccaagctattattcctggtggttcaattcattttcgaggttgcggagccaaatcctccggaatcatcaatggagtatcgatagatttttctgaaagagatttgaagtctttcaaaaagttaacatgtggcgaagaaatttatgcgcgagtttacgatgaatttgaaaactacgctacttatcaatttaaaagcatacctgagttgaggaaaagatgattgtaaattacattaaaggcgatattgttaagctatattctgaaggcaaagttattgctcatggttgtaactgtttccatactatgggtgctggtgtagcaggacaacttgcttcaaaatttccggttattttgtcaactgacaaagcagctacagattatgctgaccataaaaagcttggaacttttagcttagcgttagcactaaatggtggtgcttgctttaatctttacactcaatatgaaccaggtcctaatcttgattatggcgcattagttaatgcttttcagaaaatggacaaattcttatctggttctttgttcaaaatggatgtttatattcctcgtattggtgctggaatcgctggaggcgattgggaaaaaattgaagcactaattaatatgtttactccaaatgttgatattattgtagttgattgggacggcgaataatggctcagctttattttaactatgcttcaatgaatgctggtaaatcagcatctctgcttacagcagctcataactataaagagcgtggaatgggaacactcattcttaagccagctatcgacacacgagattcagcaaatgaagttgtatctcgtgttggtctacatgctgaagcaaataccatcactgaagatatggacattcttgagttcttcaaatgggcacagactcaaaaggacattcactgcgtgtttgttgatgaagctcagttcttaactcaatctcatgtacttcagttatgtcagattgttgacctctataacactccagtgatggcctatggacttcgtacagatttccgtggtaacctatttaagggctctgccgctcttctggcgactgcagataaactctgcgaactgaagggtgtttgccattgtggtcgtaaagcaacaatggttgctcgtgttgaccaagaaggaaatgctatcgtagaaggtgatactattgaattaggtggtgaagacaaatacgtctcactctgtcgaaaacattggtgtgaaatgactggtatttatgaataagaatgtaaaaatcttcaacacagttcttcttgttgctgctttaattgcgtttgttttcacagctataaagggaaacgcaatgagtaaacaaatcaaagctaataaattgctagcggataaagtttgtcaacttgttgttgaaggtgattacgtttctgaagcatattattctggtagtttcgaatgctataagaaggttctatgatttctactaaacaagaagctttagaagaacttcgtgatatgttacaacgcaacaccgttgttcttggctggtctgaaaagccagttacgtttgaagagttaattcgttctcgtcaaggtgatgaaatcatagacgaaatctacgaggtaattgaccgatgaaattagtcatctgttatcgctgtcttcatgtttatgaccatgataccgctcctcgtacaaagacaaagcgtcttcgcgtaaaagaagttgaatgtccaaaatgcaaatgcaaggtaacattaggatgactattgatgtattattttggttattcgcttttccagctgctgggtttatcatagcagctttacttggattcttaaagattttaattgaagggaaagtatcaccatgaaatattttaaagcaggattttactaccattgaggtactttaactcaagaggtagatatgtcaagaactattcgtcgtaaaggttttaataagcgcacttcagcacgtcgtttccagcaatataacaacgaattttaccatctgtgcaaagacacttatcgttgcatgattattcgtggagacacaactgaaatccgtctgaaaaacaatcaggactggttagatgaagtcgcttctgaagtacatcgcgaagcttcttacgttgaagaacgttggcatcgttatgtgacatccatcccgcgcgtcatacacaagatggaaatcaaacgctcgttgagaaacgacacggactacaactgggacgaaaaggctgctcgtaagtatgagaaaggtctttgctattggctgtgggactaaagttaaattggggagcatgctcccctttataaatactattactaactaatgaggtatgtatgaagcatttgaacgataagcaacttcgtaatcttggtgtatctcaactggaagaaattaagtgcgagattggccacgctatctcaagtctaaacgaagagtttcgccagcatggtgcacgcccagactatttgcgtaaacgccagctgcaaaaatacctcgataaagttaaggctgttcttcagcacaaacttaatacaggacaacgctgaggcttttatgactctacgtgcattggctgcgattttatttgcagccactttaatctcgcccgtatcggcagaagaagcaaactttgaacaatacgctgatggtgctatggtagtatatagcaagttcaaagaaccttctaaagaagaatctgaacgtttcttttctttcattaagcagaaatgggcagcttcaagttgtactacccagtgcactgaagaaggagttcatgctggtaagcaatatgtttctctaacgaaggttaaacttgaaaacgaaatttgaagatttcataacaaccggaaagaaacttccagaggatgagttcattggtcttttgatggcttctgcatcatacttccactcagctcattttgaaactaaaagctatgctcgtcacaaagcatacaatttcttctttgatgcaatccctgagttaaccgacaagttcggagagcaatggcttggatggtccggtaaaaagtacaccccatctataccatcgcaacaggatttgcctactgacacgattgagatgctcgatagcatcacagcaaaagctgaaagcatctacgataagatgcctggagcaatcagaaacacaattgacgaaatcaatggtatagtgtttcaaaccaaatacttgctgtctttggaataatttgagccctgacttttttggtcagggcttttgttgttttaaaggaaccgtttacatcctcttcaaaaggtgatactatgaccttacacaaacaagaggagaacatcatgaatcgcattactaaattatctgatttcgttccaggccgcatcatgtatcatgtgtacggtgtatctcgtactgaaactactgtgtcgctggatgaagttagcaagtacattatcctcagtaaaccatatcgtagcccaacatcagatatcttgatggttgatatcatctgcgagtatactgacatcaacggcgaaacaaagcgttcttatcgtactcaaatttgcccgggtgataacgcagtatttgaagaccctgaacgtaaacctcacaacttgaaccgtctgttcggtgatgttgaatccgctttggaatttatggctgaacttaaagcagataaattctcttctccagaagaccaggaatatgcggactattggacaccagtccgagttctggaagaacgtatggcttgggacatctacgatgatggcgaatttgatacggcaggttggtaatgagaacggtatttgtactgctttatctgtttgttcaataccacaatccgttgtttacatacaacttagttaatggtataatggacctcgttcaaaggagtttgtaatggcaagtggatggggtccaagtgacgacggatttgcagctattgaagctacagtaagtgatggaattgaatgggctcgtttagagctcatcaaatctcaaaatcgtgagagtgaaaaatactgtgaagattgtgacggagaaattccagaagctagacgcaaagctcaaaaaggatgcacacgatgtgtagcttgccaaagctcacatgacactatcattaaagcgtcttacaacagacgcggttcaaaagattcgcaattgaggtgattatgaaatatacatttgaaagcggttcagtacatggtcctctggttcttgaagtacgtggaaacttttgcaaacttggtcatgaaggtgatgaagatttgttcaaaatccattttcgtctggacaaagcacatctgattgaatgcaatcaatgccctaatattgattacactgattatggtgatgattcatttacttttgaagcaaaagatggaagctatggctgtgtatctttttgcagtaaagagaatcttgataacttcttaaaagctattcaggagatgcaatgaaagacccttggggatatgaacaatttcatctaggaagtttagacattcgcactaaagaagatgaaattgttttggagcatgctgtccctgaaggagcatgttatgccggctctcctcttcatttaagtaaagaagaggctttaaaggtagcgtttttcattcttaaactttatgcaggagaagtcaatgagcctaagtcttgagttaaaagatattattgttactcgtcaatatgacggaacatttcagtatgaaatttgtactcacgtaagtgctacgggatttttgatgtacaatttctccactcaatacaaaccgcatcttgagagatttttgaaatatcatgaatcgcttccatattcttctagtatagtaagagctaattcagaagaatacacagaaacaatgctcaaaattcaagagcaacttaaagaacgagctcgtaaggaacaagtaaatgactaagtgcactttagattggaacgtcccagggttagatgctactatcaactatgaagctgacacgctaaatggtgtccatgttgatattaaaactcatctctctgttgatgatgagaaagatacaatcacaatctattctcagggcgatgaaattgagcttcttaaagaagaagctgagaaattgctttcatggttgcaggttacaatacctcatatgaccacttctaaaaactttaaataactgaattgaaaggaaattataatgcaaatcaatactaactcttggcactacaaactcgttactatgaatggcgctgaaagcgctccacgttctctgtgtccttatttttggaaaggtgtatggcacacattccttctggcatttgctgtattcgctgtgtgcttcgctggttggggttctggtgttgatgtagctacatggttgtttgctaagtgtggcgtagttctgtcttctgctgcagcaattattcctggactgattgttggttggcttattctggccgctatttttggtacaattttctgtattggttacggaatttatcgagtcgttcaaagacgaaaagaaaagaaagaagataaaaaatgggaagctatcagaaatggcacttacgttgaaccacaacctaatatcattattgctttcattaaagctcgcaaagagaagttctgcccaactttggaatttaaataatgcttaaacaagaccagaactatattatcaacggtgaatctgctaaatttaatgcaactgtggacaaaggctttactggcctgcgtccagtagcagaatttatttttgctgacggacgcaaaattacagtagttcatgacaaactcagcggaagttctacatcttccgaaatgatggaccgttcagttgcatatcgtaatggctcatggcgcttcttataggaaaatattatgtttattcgtcaagtgaaagctaaaggcattgtaaagaaagaacttgaagttggacgctcaattactgttcaatccggaacaacagaatttgatggtgaaattgattttattagccgttgccaaggagcaactcatattttccttaaaatcaataaaaatcaacgagctgttttaaaagtatattcaactcgtgtaatgattgaactcttcatttatgatgaagataaaattacatcatacggcgttactaatgtgtatgtaacttcaattcgtaataagtacctggttgatttcactaatttcagaccaaaagacggccgatatacagaaacatatgaagcggaagcttctggttttaaaaatattccggtagttgttggtgatgtcttccaaaagggttctaaagaattcactgtaattgctatcactaaaaatggtggtacaatgttcctcgaatccgaaagcggcgacggtctgccagttaatctgaatgacacttcattgattgcggctttcggtggtcaattcacacggggtcaaccgactaaatgaaaacagttatgaaaggctacttcggtagccatctttacggtacgtcaacaccagaaagtgacacggacttcaaagaaatcttcgttccacacccaaaagatattcttatgggtcgtgcaatgaaccatactaatatgaatactaacaacacttcaacaaagaattctcacgatgacgttgaccatgaactctattctctcaagtattggttggaactcgctcagtcaggagaaactgttgctcttgatatgcttcatactcctgctaatctgattgttaaatctgacctgcctgatgtctggaaatttatccaagacaaccgctggcgtttctacaccaccgatatgaaagcttatcttggttatgtgcgtaagcaagcggctaagtatggtgttaaaggttctcgtttagctgaacttcgtaaagtgcttgaggtgttagagccttatccagaatggaagtatgaagatcgtccaaaggataaagctcacaatgttcgttggaaagttgctgatattgctcatctgcttccgatttcagagtttcttgaatggactgatttcgttgaccacaaatctggcgtgcagaagttctacaacgtgcttggccgtaagttccagacaacaatcactgttgccgaaatgaaatacagtctcactaaactgtggaacgaatatggcgaacgtgctcgtaaagcagaagctaatgaaggcgtagattggaaagctctgtctcatgctcttcgtggtggccttcaactgcaggaaatctacacaactggtgatttggtttatccgcttaaagatgctgagttcatcaagaaagttaaagccggtactattccattcaaagaagttcaagaatggttagaaaactgcgtagatgaagttgaacgtcaaagcatcatcgcttctaaaaacggtatgcctgataaagttgacatgacgttctgggacaagttcttggaagaagtttatctggctaaccacaactcttactacaggtgattatggttactttacttttggctcaactatggtggattatgcctgtctttattgcattggtttatctagccgtcgggtggctcatcacaaacgctctcgttaaacgagggtacatagagacaccttttaattacttgtttagtattatattatggctgcctgtcggtgtcatacaagtcatctggcgtatcttaagttggttgttaatgcaaccaaagctgtttgctgaacgtcagctagaaaaacactcaaaataacctccttcgggaggttttgttgtttttaaagaaagttttcaaaagtgtttacaagtgctatagcatatggtattatagcactatcaaaaccaaaggagaacaaaatgaaaactttagaaatcgtagttaaaaatatcgctcaagctaaagcagtagcacaggagtataaggttgaaatcacttctgaaaagcaaatttcagaaaagtattacatcgttttggaaggtacttcagatgctctgattgacttcgtagatgagttcttcctgaattcttcagttcgtccttactacatcaacgaaattttggaaagctaatgaaaactacacctattgaagtaaagaagttgattgacacagaagaaatttcagcatgttttgaaagtttcttagaagatgcaaccgaagataacgcagtttatctcgcccagaaaattatcgaaacttatttggagaaaaaccaatgacagtttacgtagatgttctaatgaatcatggatggaagcttcgtggtcatccaactaaaaattgtcatatgttcactgatggagatatcgaagagctacataaagtagcagaagcaatcggaatgaaacgttcttggttccaggacaaacgcattaagcactatgacttgcgtgcagaccgtcgtcaaaaagctgtagagcttggagctgtagaagtttctcgtcgagaagcagtaaaaatttggcgaacattaaaataaattgtttacaacggtatgagatgatgatactattacctcataccaaacaaatagaaactcggagaacaaaatgaaaaccatcactatcgctaaaggtactaacttcggtaaagaaatctctggtaccttcgaacttctgggcgagtggttcccaaaagatttatcagaatctgatgctgctcagggtgatggtaaagtattcgtaaacatcgatggtaagaaacgcggagtatgggttttccacggtgattacaaaattgaaggtcaagaagctaaagaagttctgaccgaatctgttgaagaaatgaaagctcgtatcgctaaacgcttcaacgtcatggggttaatgactgctggtctggttaacgggaacattcgttcactgattatctcaggtgctgctggcatcggtaagactttctccttggataaagcattaactaaagcagatgctcgcggtgatattgaatacaaaatggttaacggtaaaatttctggtatcggtctttactgccgtctttgggaatctcgccattcaaattctgttctgcttattgatgatgtggacgtattttctgatatggacattctgaaccttctgaaagctgcacttgattctggcgaaaaacgtaaagtttgctggtcaactgcttctgctttcctggaagaaaaagatattccaaacgaatttgaatttgaaggtactatcgtattcatcactaacgttgatattgacaaagaattagaacgtggtagcaaattagctccgcatctttctgctttggtatctcgttctgtttatctggaccttggtgttcacacaaatgaagaaatcatgtctcgtgttgaagatgttattatgacaaccgacatgttgcagaaccgcggattaaagcactaccaagtacttgacgttctggcatttatgcaaaacaacgttaatcgtcttcgtaatgtatctctccgcacagctctttatctggcagatttcgtcgctactgacgagaaaaactggactgaaattgctgaagtaactatgctgaaataatcaaccacggggcgaaagccccaattgaggaaaatattatggcttctttaatttccaatgatgtaaagcgaattttatttaaaagcggaatgtatattgttgatgttcctaaaggaaatacttcttcttggactatttcaaactggattaattatatcgacgaaaatggagaatgggtacaatgaaagtaatcagtgtaaaagaatcagacgtctatgtcgccagagtttcaccagacgaccgccgctcagaagtttatggttactatgactcttattttaaagctgaagagagtgtcgctggtaaatcctggtatggttcaaacggtacagttgaccggcatcctgtcaaagctttgacacttacatttgaagacggaagcaaactttctttcttaaagaaagatggttttgaaattcgcactgaaacagaagcagaacgagttgctcgtttagaaaaagtaaaacaatatgctttatctaaattgaaccctgaagaaaaacgtgcattaggcttaatctgaggaaattataatgagtaaattaatcacttatgaaattaaatttaagcgttttgtcaacggtatttgggacgaaaagttccgtgtagcaactgtaaaagctgagaatcaatatcaagctgtatggcatcttggcacttataatgatgaccagaacattgaagacgttattgttatggttcaatcaaaagacggaaatccatcttatttcgaagaaggttggacttacgaaactctatctggtgataaagtcttgatgacgaaattcaaagaccttggcccagaccgtcgcacaggttacgaaactattatggacgaaaatggttgtcatcgttatactcgtcgtgaccaagggcgttgcacaggttcagaaaattgtaaccctaagaatattcagctcggtgttttctggatgcgtatggatattgatgacccatatgattttgttatggaacgcaaatattctgataatgggaaaggcgttaaaagcaaagaacgagttgaggtgaaactgtgagcattcaaaaagtaaaagactgggttgcgcaaacttctgtttaccctccggcacatatttaccaaggaatggttcaaggtaaacaagagaagctcgctattaaactttgtgaagagttatataggtttaatcatggtaaccagccaaatgtcttaggtgaacttagagcatcctggcgagaactcgaagttacaatgaaaatggccgaaagtgattcagaaaatatctttgttctagattcttattgggctaaggtaattggcgagttcttgtactgggccaaagaagctgtccgtaaaatggatgaagtttataaagggcatcaagcagtaaatgcttattacaacgaatggaagcttaaagcaaaagaaatcaattcagcaatgtatgatacagtaactcctcaattgtggattaaatgcattgaagtgtatgacgaaatggtgaaaactcatgacaagtgaacaactcaaagagttcatcaaaacttatttaaaagagaatgcgcaatttgatgtctatgctccatcgtacaaagactcaactatgcgcgtaacgttaacattagaaggtgaagaaatagcaacggcagcggtctgggcttctgatattcctaaggattcaagcccatggtaattccagttcttattgctttagcaatagtggtttatttactaggtggagttgcctttcttaaaactttcgcttggtgtcttggaatgccggcatcaagctgtcgcactactaaacaaaaagtggttaaatacttggcagaatggtctatgattttattctatccgttctggattattttcatggttggtgttttaattgtaggtaaataaatgggctacggattagatgaactaaacgattggtatgatgattatgaagacgaagactatgaaaatgaagaatatggtcacgagcctcggcccatcaacttgcatggtgaccgaattgaagtcctcagacttctcaacagtagtcaaaggactagcacaactcgagaaagaaatcgagaaagaaagcttacagaagtcaaagagcatagtagtcaaagtcctcaaaagaaggccacaacaaccaggtatgatatcatggaacccatctaccgaaataatgcattaatgaaagttggcactacattagtatgtccaagttgcggtgagccatttaaaaagaaatcataccagcaaaagttttgtcgcactaatggaaataagtgcaaggactatttctggaattgtcaccccgaccgaataggccgaacagaggagtggaagcggtgagtttgaaatctacagccttagaaatgcttcgaaagaacaatagagaagcaaaattagacttttataatcgtatgactgattctatagtagaatataaaaactctacggatgctgcttttaacaactggcttaaattgggaagtgaagtgccattggtaggaagacagattggcaaacgaacttatatgaaagaaaaatgtaaagctctaatcgcaatggaccgtgagcagttgcaagctgcacatttgtttgagatggaaaaaattatcaatgagactctttataacaatcaaatgcaaacagctgttatagaaaagtctgtgtggttctctggcgaacctaatactccagcttatcactaaagttcgccccggcttcgctggggcatttttgtatcctcgtaatatgatttatcatccttcctaagaaagttcctctcaaccgttctggtgaatccgcattcaaccgtttacaacactaaaaagttagtatatgatagtctcgtaatcaaccaacggagaaacaaaatgctaactgaaatcatcgattcaatcttagatgaaaatcgtaaagcacatgcagcacgccgagcgaaagttgaagaacgcgctttggaattgaatgctggatgggcgaagacccgctacggtcgtgaaggatttgataaggtggttgctccaacctggggaattgatgatcgtccacatgctccgttcgatggttatctctgggaaaatgaacttggcgaagtggaagcatatcacgctggtagttatcttccatacgttacggaacttgattactttgataaaccagagtacacgagagaccatggatggtggaaacttcgtttaactgcagcaatgtatgttgaacttaagctttacggttgccctatcgaggtccgtgagccttacaaacgctgggaacttgaagatttcaccactgttatgatggttgaagtcagagctcataagaaaattcttgtggctattcaagaagcttctaagaaattctttgacgaactgtacgaatcattcaaaaagaataaaggtgaagcacccactggtaagcaaacggttaaaggtaaagtcgtttcagttaagtgctgggaagactattatggaatgcaagtcaaaatgactgtccgtcttgaaaacggtgctactgtttatggctcattaccaaaagcggttccgatggattatcgtggaattattgaattctctgcaacttttgaacatgctaaagacgataatactcattcgttctttaagcgtccaacaaaagtaaaaatttaaaatgctttctgaatccgtgatgtataatggtttcacggattctcaatcaaatcttacacctgacaatgaaggaatagaaatgaatttagtaaatacatttactaacaacaatttcaatacttacatcaaagaacttattgctaatgctgaaacgtctttcaacttcgttccaggtgaaggattacgagctgaccgaattgaaaagcttggatgtattcgtcagtggatttcaaccattttaaacactgaatttagtaaaatgggaattaatgctcgcatcaacgctacgcgaatagctactggagatgctaacaaacctgacgcctggattgatgtattgcgcagcagtggaattatccgccgtgttaaagcaaataactgtcttcgtcattacttgaccaaagccgacgatgaatttaatgacggttggattgaaatgtattacaatgttgctggtgatagaactcatgcgtatagtaaaggcggtattaagttcgctattaatcggttctctaacgatgtttctcgtatccttcgtttgggtgcagcttttctgagcgaaaacgataaagcaaaaattaaattccatctttcgatggataaatcatttttaccagcaatttcattcactgaagatgaagtaagtaaagatacaatggttatcaccattcgtaatggttatcgtgacaatggcgatatgcagcgtatttctaaacagattattgcagctctgtcaagaatgaaagttgttcgtcatagtaatatgattattgaaacttcatcgcagcatcgaattgcagtaacttttaatacgcctaaaactgacaatactgtagtggaaacatccatgacaccagtgaaagcacataacaccattgaaacttctgttgatatcaataaagcaattcaagcaaaaatcaacgagcttgaagaagagttcaatgaacttgaaatgaaaaagcgtaatcttaatgatgaagtttcacgaattagttctcgtactattcaattgaaacgtcaaatggaaactctgaagatttcgttaggaattatctctgaacctaaggctggtgtatgaaaaagcaattagcagaagatattgacttaagtcaagaaattttagacgaccctgaaggaatggagcggcttatggccgctacccgttggaatgctatgattgaaatggttgaacgacgtgaagcagcagctaaacaagttacgccttgcccaaaatgtgatagtattcaagtacaattagttaactggcaaactcctcaacttcagatgaaatgccgaatctgtttccataaatttgtgaaggaattaaaatgacaactcgtatgaaatttcttgtagcagcaatttgcttttggtgtttctctattttcactgatgtgcgtcctgacttttcaaaggaacagctcgttaaagcagaattagttcaactttattccggaacttcaactggaaaatattctcatctggaattcattgctgtttacgaagaccaaaatggtcgaagatttgacagagaaatttcacctgcattttatagcatggcacaagttggttcaatatacgatttggaaatacgacctgagttaatctattcagagtatcgtcaaggctggaatgctgcttggtcatttggttcagcgttcctttatattatcacttatatacttgctttcttcttttctgtgatagtatgtttacctaaatcggctattgattggatgaattcagatatttaagaggaaattattatgtcactcattgatttaaaattagacaccaacacaatccgtcagctgttcccagaaggaacagaaattcgtgccgccctgcaacagtcagttattcagaacatcgtcaaagagatggtgcttaaagactctgacaataaaattcgtaaagcagtttcacaagaaattgatttacttggtgctcgtgttccttcagtaaaagctgctgttgaaactgaactcaaaacgttcttcactaagcgcggttggaataactatgactcaacgtttgagttagatactgcaatgcggaaagaagctactgaagtcgctcagaatattattcagaataaaattactaagtgtattgaagaagccgctaaaaaattagaaaaccgcattgaagatactcttcgaatgacagaacatcgctgggaacaaatgattgtttctcgtatcaataatcactttggtaatatgctcgataaagcaattgctgaacgtattgctgccgctttccctgaggtgaagaaatgaaaattaccggtgcactttggaaagaattctacaacgatgaagccttctgggaaggctattatcatgacgatacactgattctgtttgatggtgtagaagttgaagattatgaagacccagctccagatgcagtagttacaattgagtctggttacgtctataaaaatgatgaagacagttttacagctcatgaccttcgtttagaaactttctttaagcgttggaaaaagaagcaaacaactcgcactattgtggtcacagtcaacaaagacgattttgacgaagtgttagaagtcatccgcaacattcctggtgttaaggcggtcaaatgaatccatttcaaagtagtgctatttctgaaactgaagagatgaaatctctgtttaaagagcttcgcgaagttgccgggcgtatttgtcttcaatacgctgaagaaaaaggtgaaaatcttaatatggaccatgtccatcgttctcttcacgcttcaattgattttgatgttataatgttcaaaacatatgcataccatcaattgaatagtcagcctaacacttctcttccaatgagtgaaaagattgctgttgcagctcacgagtcttataagagattaaaagaactatgagccgtaaagaatatatgattgaggctgaagacagcctcctccgaatgatggtagcttatcataaagaccatggtaaaatgccggattcttattcagttttgaagagtgctttaactcgcgctcattcatttgcgtttggttcaattaaccgcgaagttgcaaaacgacttggtgttaaatgggaccatcgcacacaaaatcatcccgactacgataaagtagtctcatcagttattgaggacatctctagtgacattcaaggttttcggttacgacagcaagcattttaaatgtgttccatgcattaactctaagcgtctgttagatgctaaacgtaaagattacgagttcatctctgtgacttcaggtaataatgaagatggtacaccaatctttaatgaagaagttatctctgagcttttgacgcgtttgaatagaccatctcgtgttggtctgacaatgccccagatttttgatgaaaaaggttcgcctatcggtggatttactgaattgaaggaatatttgaaatgagtctgaactctgtattgattgacccaaagacagaagaagtaatttgctctgctgagcttgctcgtcttcgcgaatgcgaagctttactttgggaagtcgaacgttctcttccaagtggtttagaatcttgggttgatgatgaagttcttgaaactttacgaggtgaataatgatttctgaaatgaaagaaaaaattctgaaagaaatcatggaagaccatgatgggcattcagagtattacgactttgaagactctgattatcttgaagaagtagaccatgatgaatggactcagaaccacaagtatcaatatcgtcaagtagtttactacagcaagaaacatgacgttcacgtcgctgtaaatgaaactcgttctggttcgtatcatactgattggtactatatggagcctgatgtctcgttagttgagaaacgcgagcgtaaagtaactaagactatcacagaatgggttacgctctaaaaccttggtatgcggctcgatgggaaactctcgagccagaggaagaagaacgctttcctgaagatgattataatgaacctaccaacaatgaattaatcgatatggagtttggatatgagtttcctgaataaagtttttcgtgttattgaagaagatgaagagctgctttctcaattccctgaatttgtaaagggtgcagaatttaaagttctgagcatcagtaaagtaggcgaatcaactggcatgacttctgttcaatttaagaatggaccttatgttcatgttaaaactgctactcatccagaaattagtggtcaagattcatggttctggtgcttctactctgatgaaattgatcatttagaagaacttgaagaactttcttctgaccaatacggctcttctgaagatatccctcgtaacctttttaacggaaaagatatcactgcgcagctctataaaatggctggtcaagaaaattgtgattccgaagaatacgatttgatgcaagctgctgcagattatattcgttggcttgaagctcaattggagtttaactccaggaagttctaaactataaatagttcatctaatattgaggtgaactatgttattgaccagcaaactctacaaagaagaaaaacaaagactatttgatgcacagcatggtatctgtcctatttgtaaacgtgaattagacagcgatgttcaaagtaaccaccttgaccacgaccatgaattgaacggaccaaaagccggtaaagttcgtggtttactgtgtaatttgtgtaacgcagcagaaggtcaaatgaagcataagttcaaccgctctggtttgaaaggtcgtgaagtcgactacctcgagtggcttgagagtttgctgacctatctgaagaatgactatactaaaaacaacattcatcctaatttcattggcgataagtcaaaagaattcagtcgacttggtaaacccgagatgatagctgaaatgaatgcttacgggtttacctattctgaagatgattccaaaccaaagcttgttgcttcattcaaaaagcaacttcgtaagagtttaaaatgacaattgaatcagaaatccagggtttaatcaaccgcaccaacaaagacttactaaacgagaatgctaataaagattctcgtgtttttccaactcaacgagacctgatggcaggaattgtttcaaaacacattgctcgtcaggttatctctcctactgttctaaatgctcatgataaaggtcttattcattttcatgacttagactattctccagctcttccattcactaactgttgcttagtcgatttgaagggtatgctcagcaatggatttaaacttggtaatgctcaaattgagactccaaagtcaattggtgtagcaactgctattatggctcaaatcactgctcaagtagcttcacatcaatatggtggaacgacatttgctaatgttgatgttgtacttgctccttttgtagagaagactttctttaaacatttacacgatgcagaaagatacggcattgagcatgtcaatgactatgtatacgcgattgagaaaacagaaaaagacgtatacgacgcattccaagcttatgaatatgaagtcaatactttgttcagttcaaatggacaaactccattcgtgacaattacctttggtaccggtacaagcgattatgaacgaatgattcaaaaagctattctcaaaaatagaatcaaaggtcttggacgagacggaatcactccgatttttcctaagctcgttatgtttgttgaagaaggaattaaccttcatcctactgatgtgaactatgacatcaaacaacttgcattggaatgtgcaagtaagcgaatgtatcctgacatcattagttcaaagaataaccgtctaatcactggctcttctgttccagtttctccaatgggatgtcgctcattcctgggcgtatggaagaacaaagacggcaaagaaattctcgatggtcgtaataatcttggtgtagtgacaattaacctaccacgagtagcactcgattgtatggttgatggccgtccagacttgaccaagttcttccacattcttgatgaccgtttgaagatttgtaaagaagctcttttagctcgtattgaatcacttcgcggtgtaacagcttctgtagctcctattctttatcaagaaggtgcttttggtgttcgtcttaagccaaacgatgagattctcgacatctttcgaaatggtcgttcttcaatttcgttagggtacatcggaatccatgaagttcaaactctattgggtgctgatatcggtaagcttcttctgaaatgcctgaatgattatcttgctgaatggactaaagagactggctttgcttttagtctttattcaactccagcagagaatttgtgctatcgcttctgtaagattgatgctgaagtccatggtgatatcaaaggcgtcaccgataaagggtggtacaccaacagtttccatgtttcagtagaagaaaagatttctccatttggtaaaattgaccgtgaagctattttccacttcatcgctaagggtggtcatatcagttatgtagaacttcctgatatgaaaaacaatctcaaaggccttgaagctgtatgggattatgctgttgagcatcttgattacttcggtgtaaacatgccagttgataagtgctttacatgcggttcaactcatgaaatgactccaacagaagatggatttgtctgtcatgaatgtggtgaatcagaccctaaaaagatgaacacaatccgacgcacttgtggatatcttggaaatccatctgaacgtggatttaatcttggtaaaaacaaagaaataatgcataggacaaagcactgtgaagtatgacagaatctatccttgtgattttgtgaatggccctggttgcagggtcgttctttttgtcaccgggtgtttgcataaatgtgaaggatgttacaataaatctacatggaatccgcgtaatggaacagaattcaccggtgaaaccattggagaaatcagagagcttcttgagcctgattacattcaaggaatcactattactggtggagaccctctttatccagacaatagagaaactatagaagcactgcttaagtgcttacatactagtcaccctcataaagatgtttggatgtggacgggctacaagttcgaagatatcaaggacctggaactgctaaattatgttgatgttattatcgatggtaaatatgaacagtctctaccaactaaaaagctttggagaggcagtgacaatcaaaggctgtggattaacagcggaacttggaatgaggaacacaatgaacatcctgaataaactcgcactaaacgcaaacttcatcattcaaagctggggcgaagaattccctgctctgtacgttttcgctggtatcgtaactttctcctaaggaaaaacatgaaatacatcaaatctttcttcaacgggactcgtactgctttatctaagcttctggcttatcttgttattgcttacggaattattgttgctgtacctgcacttttggtattcggactggcagtgattatcgctcctaagaccgatgataaacctaaactttctcccgaagaagttactgctcgtattcgtcgaatgactgatgcgcttaaggatattggtttagatgataagcttgaggttacagtcaatggaaaactcacaactaagagctaaaatttatggaattccggaagacgtctaccgctgcgctggttgcgcagcggtcaaagaaatttttgacgaattcaaaattccgtatgagttcatcgacgttatctacatggccggtgacgtccaatacaactacaaagcgattgaagaagccgctaaagcctcaggagttttcccaagcaagcgagtcaattacccggtcgtcatcctcggtggtgtatattacccaaatctaagaacaataaaagagagacttggtgaactaggttacgacctcgattcactggattaactctaagacactttcttttgaagtccatataaacatacggctcacatcttcggggaccctagcggtccccatttttatttctaccaaccgtttacatccgttgcggaaggtgttactatactcttacaccaaccaaggagagtaacatgattacactgaaaaagaaagtaactgtcgagttaggagttttcattcgttctgaaagccgtggtcaagaacgtatgaacattgaaatcaacaacgttgaagttgttcttcgtggtcgttcgtgtatgacagaagtttcaattagtgcagcgcgccatcgtccaagttcaatcacaaatgctatctatgctttgatttcagatattgaaaaagatgaagcggctgaactgactcgtgctatctacgaatacgtcaaaaactgctaattttgctataagggattcggaatagaatctcttatgtcaaacttagttaaaatgaggaaatcaatatgtcacaggctatcaaaaacgtactgaacgctttcgtattcccgaaggtggaagcaatgaaagttgatggtgagttcaaagacgttatcgtgactcctaagttgctggataagtgggaagttgaactgcatggtacgatgaaagaaaatgaccagaaaattggtaaagctcgtattcgtgaactggttgttgcttacattctgtctgaatttaatcttgatgctttcggtattccaactataaagcgtaaagaaatctctgatagcactatccgtaagatgaagaaccagcgcaagaaaggcttcgtcgacctcaaaattgttaaggctgccaaatgaatgaaggtataagtgttatcatattgatatctcataaaatagacgtttggcattctaagctgcatgctcgattcgtctttggaaccaattgggaagatatcaataatgctgttgattatctcaaagcatgcgaaatgataaacaaaaatttccaagttagatatttcccggtccaaaacagaagtgtggattatcctttttatcatatgtgggaagaaggaatgacagaggaagaactgaaggagtacctcgatgaatgaaattgaaaatgacctgcagctagctggatttcaaacaaagcgtacggaagacggccgcttaatgattgaaggtacttcaaagaacgatgttgatttcgttattgaagaagattttgacgcctggtgggtttatgaatacactgggaaagactatcactcagtagatgcattcggaagtatggatgaagctattgaatgtgctaaggaacttatcctatgaaatataatcaattcactatcacagtattgaactacggcgactgggttattcgccgtgatggtaccgtttatttctctgatgaagagactggtgcttactgggaatctgatattgctattttccgcgattacactccagatattctttatcgcgaattctgtgaagaaacttgcgaagaccttgaacctatgcactacaatacgtttaagactttaattgaagatacttttaaggtatttgacttatgagccgaattactttagataatattgaaatcgcgtcattccgtgttactgggttgggtgaatttttcgtagataagtggatgggaattacattctcagactcaaatgaacctggtcctagtcttgaatatgtctggcgaggccatgtatctaagctgaatgaaaacggctacatcgaattatggaaatcatggctcagattctgtaatgaaaatgcttttgaacctgaacttgactttgttactttccgcaaactcatgattaagtgcttttcgctttacgaactccttaaatagatgcttaaaatacccttcctccaaacgtgttataatattcttattaaatgaagcggaagaggtaatatggctaactatgtaaataataaggagttgctgaaagccatcactgagtggaaacagcaatgccgcgaagctggtaaacctgttcgtcagaatgatactatcggcagagcaattatgttgatatctgagggtctgagtaagcgttttaacttttcgggatacacccgctcttggaaagatgaaatgatttcagacggtgtagaagcttctattaaaggtctacacaacttcgatgaaacaaagtacgacaacccgcatgcgtatataacccgtgcttgctttaacgcattcgtccaacgtatcaagaaagaacgtaaggaagttgccaaaaagtacagctattttgtccacaacgtctatgacgctcgtgacgatgatatggttgcgttggtagatgaaacttttattcaagacatctacgataaaatgacgcattacgaaacctccacctacaaacagccagggtctgacaaaaagagcgatgttgtagatgaaggtccgaacttggattttttatatgaggctgacgattaacctcgcaggtttcctggaagaagtgcccgattacgatgctatcccttatttgcttaaaatgtatatgagggaggtattggatttggacattcacatcgaccccaagaacccacatgacgctgaattcacttctgataatgctgagataactcacagttataatctaggagaaaatgattttagcataacaattgattacaaaagtaagtaggtcaaatgaacgaacgtaatattgacagcgtagaacaaatcgacgataacgaagaagaacgtattaaacgtttgattgaagaagaagaaagccagagacgtgcaaatgctatggcgactaaaatcttcaaaaagaatcgtcgtgaaattaagcgactgaatgaccacgcagctggcgcagtcctcgaaaataatttcgaagcatataagtacgctctctgtaaactgcgtgacatttacaaacaaccctataatgacgaaatcatccgtgttaactggcagactacacgccaacaagtatgggaaatcatcaatgctggtacaaaaaccgtttaagcgtttaaaagttaatgcaggttttactctgtcagtttccaatggagtcatggcagtaaaactatccgaaactcattatcgtgttcttggaagcacaggcccggcagtaaaagcttctcctaaagaagttgtgtgggttgatactctccaagttaaaccatggtggaaactttaatgttgcctcgcagcaagcctcaagattggtcttctggcgattatatgtgcacatgcagagattgcggtatcaattatatcggtccaaagcgttctatattttgtaatatctgcaattcatctgaaaagccagaatcaaaaattgattatgaagctattcgtaattcaaaaacggaaatgttgaaaaagttcaacgaagccaagaaattggccgaggaattgggttatgttctcgttaagaaaatttgatgaagaagatttcgatttctttgatgaatttgacggattttaattaagggccttcgggccctttctgctttctggagtatagagtataatctctttgaggtgaaaacatgaaaatattacacacaggtgactggcatctgggcgtaaagggtgatgacccttggcttcaagaaattcaacgtgatggtattcgtcaaaaaattgagtactctaagaagcatggaattaccgtgtggattcagtatggagatatttttgacgtacgtaaagcaattactcacaagacgatggaattcgctcgtgaaatagttgatatgctagcagaagctgggattacgatgcatacaatcatcggaaaccacgatatgcattataagaataaaattcatcctaacgctatcacagaagtattgggcaaacatgaccatatcaaaatttatgatgtgcctactactgttgattttgacggatgcttaattgacctaattccatggctttgcgatgaaaacgtagcttctattatgacgcatgttaaagaatcatctgcagagtattgtattgggcactgggagcttaatggcttctattactacaaaggtttaaaatctcatggtctcgagccagatttccttaagtcatataagcaagtgtggtcagggcatttccatactatatcctctgctgccaatgttaagtatatcggcactccctggacccttacagcaggtgacgagaacgaccctcgcggattctggattttcgataccgcaacggaaagtatggattttgtgccaaacgaaaccacctggcatgtaagacttcaatatccattcactggtaagattgattacaacgactacaaaaatctttcagtccgagtaattgtcactgatgttgataaagatatcactaagtttgaaaccgaactcgaaaaagtagttcacgagcttcgtatggtttctaaggtcgataattcagttgaatctgacgatgatactgaagtggaagttaaaagcttacttgaccttatgacagaatatattgatgcattggaagacttatctccaactgataacgctgcattgaaaaaatttgcacaagctctttatgttgaggctcagaatcaatgaagattttcaaattgaaccgagtcaagtatcagaatattatgtcagtgggcggacagcccattgatattcaacttgataaggttcacaaaacattaatcactggtaagaatggtgccggtaaaagtacaatgcttgaagcaattacgttcgcattgtttggtaagccatttcgtgatttcaagaaaggccaattaattaattccacaaataagaaaggactgctctgcgaattgtggatggaatatgacggccattcgtattacatcaaacgtggacagaaaccaaatgtctttgaaattgaacgagatggtgctaaactcgatgaagcagcttcagtcaaagatttccagagttatttcgaagaactcatcggaatgtcatatgcaagcttcaaacaagtcgtggtactcggaacagcgggctacactccgtttatgggtcttagtacacccgctcggagaaaacttgtcgaagacttattagaagtttcaattatcgctgaaatggacaagttgaataaagctcttgtcagagaattgaattctcaggttcaagttcttgatgccaagaaagatggaattcagcaacaaatcaaaatctatgaagaaaacatagagaagcaaaagaaactttctggagaaaacgttgcacgttggaaaacgatgtatgaagaatctcttgctgacgctaaatctattcgtagtgtgattgatgagttgaatgctaatcttgctaacattgtgattggcgaagaagatgatgtatctgaaggaattcagaagactcaaatggctggaataactatccttaaccgtatcgagtcttatacaaaagttttgtcattgtatgataaaggtggacactgtcctacatgtttgcaggatttacacgccagtgacactctaatcggccagattaattctaaagttgatgaatgtaatatcaaacatgctgagttaaaaacacatctagagaatcttcaggcgtcccagactgaattcgaagctgtcaggcgtagagctcgtgatatcaaaactcagattaattcaaaaactgaagaactcaaagcatcagtagaacgaattcgcaaaattaaagcagctattgataaagcagctgaagaatttattgattattctgatgaaattaaaacgcttacagaagaattgaataaaatagttgataccaaatccaacatcgttatggaaaaatatcaacgtggtattcttacggaaatgttcaaggattctggtattaaaggcgcaatcattaagaagtacattcctctattcaataagcagattaatacgtacttgaagataatggatgcggattacgtctttacgttgaatgaagagttcaacgaaacgattaaatcccgaggacgtgaagagtttagttataactctttcagtcaaggcgagaaagctcgtattgatattgcgttgttattcacatggcgcgatattgctgaattggtatctggtgttaaaataagctgtctgttcttagacgaaatctttgactccgccactgacgctgagggtgttaaagcaattaataacattcttagtaaaatgccaaattcaaatatttttataatttctcaccgagaccatgaccctcaagcatacggccaacaccttcaaatgaagaaagttggtcgctttacggtactggaatgaaacaatacgcaaccgggaacgagttactaacgttccctgaacttaaaagatatgttctcactaataatttttctggtgaagagcatgtcgttaccgaacagcatttaaaagatgctttcggtaaacagtatgataaaatatcttccaacaggcatcctgcttggacagtttctgaattttttgaatgagaaaataatatgctgaatatcgttactgatgttaaagaaatccaacctaaaaacgtacgtactgactccaatcctaacaatcagaataaaatccgtcgagcatgggttctgatgctgcctgaagaaattaaagaagctattaaacgcaaactgccagattctgaagttcgtttcgcttattactcttctattgataattcaatctccgaaaagtggattgaattaatgcgtaagcattatgaacgttcaattaaagctggcgctaaagttattctcgataaggtcggtggtgaacgtctggaagacgaattctgtactaacgctgatgaacagctgttggtagctgctgaaatcgttgctcaagaagtttatgatagcttcgctccatttgttgtaaaatctgaatcatctgaaactgaaattgaattgaactaaggaaaaacatgaaactgtctaaagaaactctgaatattctgaaaaacttctctaccatcaactctggtattatgctgaaacctggtaagttcatcatgacgcgtgcagttaatggtacaacttatgctgaagcaactatcgctgacgaaattgattttgaagttgcgatttatgaactgaacggcttccttggtattctgtctctggttaatgaagatgcagaaatttctctggctgatgacggtaacatcaaaattgctgatgctcgttcaacaattttctggccggcagctgacccaagcactatcgtattcccaagcaaaccaattccattcccggttgcttctgttatcgttgacttcaaatctgaagacctgcagcaactgatgcgagtatctcgcggtctgcagattgacacaatcaccatcactaataaagatggtaagattgttctgaacggcttcaataaggtagaagattctgcacttgtccgtaccaaatattctctgactctcggtgattatgatggtacgaataacttcaacttcgttatcaacatgggtaacatgaagatgcagcctgccgattataaactgctgctctgggcacaaggtaagaaaactgctgctaagttcgaaggtgaacatgcaagttatgtagtagcaatggaagcagatagtactcacgatttctaattgtgataggatggtcttcggaccatccactgatttgattaattcaatatgaggaaattatgttaagcattaacgaaaaagaacacatcttcgaacagaaatatcgtccacaatcaatttcggaatgtattcttccggaatttgaccgccaagtattcgatgctatcatcaagaaaggcaccatccctcatatgattctggtatctgcatctccgggtacaggcaaaactactttagcaaaagcactttgtaacgacgtcggtgttgaaatgatgttcgttaatggttcagattgtaagattgatttcgtacgtggaccactgacaaactttgcaactgctgcctcattatctggtaagcagaaagttattgtgattgacgaatttgaccgttcaggtcttgctgaatctcaacgtcacttacgttctttcatggaagcttattcaagcaactgtacaatcatcatcaccgctaacaacattgacggtattattgaaccacttcaatctcgttgccgtgttatcaaattcggtcaagcaaccgatgacgataaacgcaacatgatgaaagagatgattcgtcgttgtgtagaaatctgtaaaaacgagaatatcaaaattgaagaccttaaagtcatcgcggctttggttaacaagaacttcccagattttcgtaagacgattggtgatttggaccattattcttccaaaggcgttattgactctggaattttggatttggtgacgaaaacttctggtgatatcagtgatgttattgatgcactgaaatcaaaagatgttaaacaacttcgtgcactagctcctaagtatgcgactaattattcctggtttatcgagaaacttgctaacgagctttacacgaaagttgataaagcaagtatcatcaggatgtatgagattgtcggtgagaacaatcaatatcatggtgtagcagcttcgacagaactgcacataacttatatgttcatgcaacttgttgtagagatgcaattcaaatgagtttattcgaagatgatgttcagctgaacgaacaccagattgcttggtatagtaaagatgaggcggagattaaacgtctctctgatactttcaaagaaacagcagaaaatgaattcttcgcaataatcggtgcaattaacgagaagaaagatatatcaatcggaactcgtgattattcgaagttcatggtagaaaatgctctatctcaatttccagaatgcatgccgtcagtttatgtgatgaatttagttggttctggattgtcagatgaagctcacttcaattatctgaaagcggctgttcctcgaggacgccgttttggtaagtgggctaagttaaacgagagcgcccaggagacactcattctgaaagtattgatgaatcattatacaatcaatatcaatgacgctgagcgttatagagtgactctagccaacaaaaataaactgtctgagacattaaaacgtcttaaaggtacagtgactgatgagctggtcaaaagcattaccaaaaacgtgaaagaacaaaagcaacttaaaaaattagcattggaatggtaaaatgattgaaattactctgaaacaacctgaagattttctgaaagtgaaagaaaccctaactcgtatgggtattgctaataacaaagataaggtactatatcaaagttgccacattcttcagaaacagggcaagtactacatcgttcacttcaaagaaatgttgaagcttgatggtcgtcctgttactattgattctgaagactacatccgtcgagattcaattgcccaactattacaaggatggggcttacttgatatcgtgactccggatgttcatcttgctgaaatgcagaataacttccgcgttattactttccagcagaaatctgaatggactctcaaatcaaaatacacgataggtgcataatgtttgaaggtactaaagaagaacaaattgaacgtcaaaaagaacaacttcgtgtcgccatgactccagatggaaaacgagtttatcctgatggttacgctttcatggcgtattggaaagacgaagaaggcgtagttcaatacgaagctgcacaaatctaaagagggccttcgggccctttctgctatcggcagagcggagtataatagacacaccaaagaccaatcactcggtctataggaaaaactaaggaaactcatggcacaagaattttatatctctattgaaaccgcaggtaatgacatcattgaacgttatattgactccaatggcgtagaacgtcaacgacgagttgaatattctccaactatgttttctcatgctcaacaaggtgtgaagacaaagttctttgatatctatgggaaaccatgcgtcaagaacacattcccaaccatgaaagatgctcgtgattggattcgtcgtatggaagatatcggtcttgaagccatgggtatggatgacttcaaacttgcttatatctctgacacttatggttctgaaattgtctatgacaagaaattcattcgtgttgcgaactgtgacatcgaagttacaggtgataaattcccagacccaatgaaagctatgtatgaaatcgatgcaatcactcattatgattcaatcgatgataagttctacgttttcgacttgctggattctctgtatggttcagtttcagaatgggacgcgaagttagctgcacgaagtgataaagaaggtggagacgaagttccacaacatattctcgaccgtgtagtgtacatgccattctattcagagaaagaacttcttctggaatacatcaatctctgggaacaaaagcgtccagcaattttcacaggctggaacattgaaggcttcgatattccatacatcatgaaccgtgttaagcatgtattgggtgaacgttcaatgaaacgattctctccaatcaatcgagtgaattcaaaactcattcagaacatgtacggtgaaaaagaagtattcagcattgatggtgtaacaattctggattacatggatttgtacaagaagtattcattcacgaaccaaccaacttataacttggactacatcgctctgtacgagactaaacgtggtaagttgccatacgatggtccaattaacaaacttcgtgaaacaaatcaccaacgatacattagctataacattatggacgttgagtccgtaggtggtattgaccgagttcgtggattcattgacctggcacttagtatgtcttattatgccaagatgccgtttggcggtgtaatgtctccgattaaaacttgggacgcaattatctttaactccctgaaagaacagaacaaagttgttcctcaaggtaagcgtcatatcaagcaaagttatccaggtgcatatgtatttgaaccattagcatgtgctcgtaagtacatcatgagttttgacttaacatctctgtatccgagtatcattcgtcaggtgaatatttctccggaaactattgttggtcaattcaaactttatgatattgaagcttatatcaataagactgcaccacgtccaagtgacgagtattcttgctcaccgaacggttggatgtatcgtaaagatattgaaggtgtcatcccagtagaaatcgctaaggtattcttccagcgtaaagattggaagaaaaagatgttcgcagaagaacgtaacgcagaagaaattaagaaagttctggcagctggcgtattcggtgacattgatactccagatgaaactcgttacactcagtacactgacgaacagaaagcgtctctgaataagtacacgaagttggtgttggaaactatgctggctcgatgtgaagctgctgctattctagcaaacacaaaccagttgaaccgtaagattcttatcaacagtctttatggcgctttgggtaacatctacttccgttattatgaccttcgtaacgcatctgcgattacactgtttggtcaagtaggtattcgttggattgctcgtaaagttaacgagtatctgaataaggtgtgtggaactgaaggatttgatttcatcgcagcaggtgatactgactcaatctacgtttcagttgacaaggttattgaaaaagtaggtcttgaacgtttcaaaacgactgacgaagtggttgaattcatgaaccaattcggtaagaagaaaatggaaccgatgattgatactgcttatcgtgaactgtgcgagtacttcaataaccgtgaacatcttatgcacatggaccgagaagctatttcttgtccgccgcttggttcaaaaggttgtggtggattctggaaagctaagaaacgttatgcactgaacgtttacgacatggaagataagcgttatgctgaaccacacttgaagattatgggcatggaaactcagcaatcttctactccaaaagcggttcagaaagcactggaagaaagtattcgtcgtatggttcaagaaggcgaagaatcactgcaagaatactacaaacagtttgagaaggaatatcgtcagctggactacaaagttattgcagaagttaaaacttgtaatgacattggtaaatatgacgataatggtttccctggtctgaaatgcccgtatcacgttcgtggtgcactgacttataatcgtgcaacggcaggattctctgtcactccgattctcgagggtaacaaggtgatggttcttccacttcgtcagggtaacccattcggtgacaagtgtatcgcctggccatcaggtactgaacttccacaggaaattcgtcaagatgttctggcttggttggactatacgactctgttccaaaagtctttcgttaagcctcttgctggtatgtcagaagcttctggattggactatgaagaaaaagcatctttagacaatatgtttgatttctaaagcattgtacattaccacatggatgtggtataattctcctatacacaaaggagaataaaatgatttactcaatcacagacgatagctacattccagtactgaagttcaatctcaaaagcacttttcacttcctgagtgctggtggtgctgataagattttctttgacgatggtattgaaatcaccgaaaagaatctgcgagctaaacttaaagagacttctatcgttaacatctatcgtgaagatgaaagtgattggacttataaacttgtaactcacagatgaggatattgaaatgaaatttttagcagtagctgctgctatgttactggcaggttgtgcttatcaaggagacactgttcatgctagtactgtagggcaagttaagtatgtaggcggcaccggtctggtgtatgctcgttcaaaccctcaaatcaatcagtcttctgttcgtgcaggtgaagagtatcttgctcagcagcaggctaatgaccctatcgctcgtgaccaagcgcgcgttatgaaaaagcagcgagaacttgacgctacttatgaaaagcgagtagccactcgtaaatgccagtttgtcattgaagcacatggtgctgctttatatcaaacaatgtataataatcctacccgcaaaaatatcaacgcatttgaaaacttcaggtcttctggccaatatgaagcatttaaacgttgtatgaagaaaaactacgaagaggcaaaatgattgtaactccactgactaacgaagatattcgtgatgaactgtgccatgctctgttcaacgagatgtttgtaattgacaaaactggcgcaaagaccattgagttaattggtccatcttttgtagtaaccgaagattcaattttcggaacagttaaccaagaatatgttgaacgtgaacttgcgtggtacaaatccaagtctctgttcgtgaaagatattccgggtggcactccagcaatttgggaacaagtttcatcttcaaaaggcgaaattaactcaaactatggctgggcaatctggtctgctgaaaactataatcaattctcattctgcgcaactgagctgattgaaaaaccagattctcgtcgtgcaattatgatttacactcgtccaagtatgcaagttgattttgaacgtgatggtatgagtgatttcatgtgcactaacacagttcaatatcttattcgtgatggtcgtgtaaacgctgtcgttaatatgcgaagcaatgatgttgtatttggtttccgcaatgattatgcttggcagaaatatgtgttagaatcattagtagaaacagttaatgcaggttctggtgaaaaatatgttccaggcgacattatttggaacgctgggtctctgcacgtgtatgagcgtcatttctatctggttgaccattatcgtcaaaccggccggattgatgttaagaaatctgactacaaaggcaaatggaaatgattcaatttgtaattccgagttacaatcgtgtcggggcagtaactgccctggatatgttccctactggttatgtacctcatttagtagttcgtgagtctcagaaagaagaatatgagatgcattacggggtgttggctaaaattgtaactattccagatgatgtaaatggcattgctggtactcgtcgtttgattactgaaatgtatcaaggccaacgaatttggatgctggacgacgacaccacaattcacactactgaaattcgtgccaaagatgaccgtcgtattctccacgatgttggaatgacatgggacgaattcaataagctcactcagtacgttgaagcagcaatggactgtggattctatcacggccatgctcgtttgcctattttcaagattgattctaagtggggtcatttccgtgagaactcttacggattcactaacactttttacgatttaagcaaactttctgctgatgacattggatatggtatagtagacctgtccgaagatacatacgcgttccttaaactcattaatatgggttaccctcatctggcgattttcaaatatctcgtcaaatctggcaaaggacaagctcctggcggcgtatcatctatgcgtaatgcggctaaacaaaaccgcgcattagaaaaaattcatgctgacttcccaactcaagctcgttggaaatcagaaggtgacccaaccaaaactatgtttggcactgacgagcctctgaaagtacttcgtatgtgcgtagccaagaaacaaaagtcagatgctttcaaaaaattcagtgagattgagcctactttatgaaaattgctatcctgaacttaggtaacaacatccaggggtttaaaacaacccctgcttctgagacaatttatctgtccgaatgcttaaaagatatggggcttgatgttgacctcatttcaatgaaaaatactcaatatggcatcgcatttgatgatgtcccagacccgaatgtatatgaccgagttctggtagttaatgcttctctgaacttctacggtggtgaagagaacaagatgaataaagcggcttatatgttcttgaacaaatataagtcaaagatttattatctgttcactgatattcgtcttccgtgggaacaagcgtggcgccgaatgtcgaagaaaaaatggtccagcaaatacactgaagagcagttcattgttcgctctccaattcgcgtaatttctcagggccgtgaccttgaacaagctaaacgaattcactctgaccgtttagtcggtgtctctaaagaccgaatggaatttgtacacttcgcattggaccgtcataagatgtatcacagcgtcttcaagattgctgctgatggcatcaaaatgcgtgacctgatttatggtggaacattccgttcaggtaatcgtgaagctaagatggttgaatatctgtttgacactggtctggatgttgagttctttggttcagtaaaggcagaccaattcaagaatccagaattcccttggactactcctccagtatttcctgggaaggtagattctcgtgaaatggttcaacgtaactcaaccgcgtatgctactatcgtactcggtgataagacttacgataataaccaaatcactcctcgtgtatgggaagctctggcatctactgcagtggcattcttcgatagcacatttgaccctgacatgaatatcatggaaggtaatgagttcttctatgtgagcaatcgtcaagagcttgttgacaaaattaataaaatcaaaaacgacgaggactttagaattgaaactctcgaatatcagcacaaaattcttcaaaaatatcttgatgaaaaaccaatttggcaagctgaattcaagaaagcaattgaaatctaaagaatacaccaccgactctgtcggtggtcattgtaatgcttgttgttacacaccttgtcaaaatgattcaccgcattgcaatccgctttaaaccgtagttgatataattactctatcttaaacctgtgagaaaaatattatggagacttatggaaaataattaatgtctgatttaaaatctcgtctgattaaagcatccacttctaaaatgaccgcatctctggataaatccaagttcttcaatgaaaaagatgtagttcgtaccaagattccgatgcttaatatcgcgatttcaggtgcattagatggtggcatgcaatcaggtttaacaatctttgcgggtccatcaaagcacttcaagtctaatatgagtttgactatggtttccgcttatatgacaaaatatccggatgctatctgtctgttctacgactcagaatttggtatcactccagcatatcttcgtgcaatgggtgttgaccctgaccgtgtagtacacactccagtacaatctgttgaacagcttaagattgacatggtaaatcagctggaagaaattgaacgcggtgagaaagttatcgtattcattgactctatcggtaacctggcttctaagaaagaaacggaagatgctctgaacgaaaaatcagttgcggatatgactcgtgcgaaatcactgaagtctctgttccgtatcgttacaccttacttctctatcaaaaacattccatgcgttgcggttaaccacacaatcgaaacaattgagatgttcagtaagactgtaatgactggtggtactggcccaatgtattcagcagatactgtgttcatcattggtaaacgtcaaattaaagatggtacagaccttcaaggttatcagtttgttctgaatgctgagaaatctcgtactgttaaagagaagagtaagttcttcattgatgttaaattcgatggcggtattgacccatactctggtctgttggatatggcgctggaacttggttttgtagttaaacctaaaaacggttggtatgctcgtgaatatctggacgtagataccggtgaaatggttcgcgaagagaaatcatggcgtgcaaaagatacttcaagcaccgcattctggggccctctgtttaaacatcagccattccgcgatgctattaaaaatcgctatcagctgggtgctattgaaaccaatgcagtagtagatgaagaagttgatgctctgattaattcgaagaccgaagagttccatgctccggaaggcgaagtaagagcaactccagcttcaatcgaagatgaactggaaaattacgatgaagaataatttcgaggacttagacctcgatttgactgaagttgaagttcaggacgaaaccccctctcaggagggggaatttgaaagaactgagcggatgtttaaaaagagtctagaaatagtccaaaaggctatggagaatgtcgttcaggaaatcctgataaccctagaggatggcgaggaacatatcgtatatgttacctcattacacttggacgaaagcggccaggtgtcactagagttctctacgttggacgaatcacgaaaagccgaccttgcaccacatgttgaaaaatgtattaaaatacaaattcaacaggctcacgccgaaattatgagaaagaaaaaacgtttcaaactattttaatgaggttatcgtggtagaaacaatcttatctcatttgctgtataatcaggcctttttcgcgaaggtttggccttatatgggagatgagtattttgaacatggcccagccaaaaatgttttcaaactgattcatcagcacgttcttaaatatcaagctgttccaagtaaaactgcattagcggtagctttggataatagtcagttagttgaaactgaagtacagggcgcaagtgagttaattaataagcttcaagatactccagaagatttaaactggctcgtagctgaaactgaacgttttgttcaagaatctgcgatgtacaatgcaacatcaaagattattgaaattcagactaacgcccaacttccaccagaaaaacgaaacaaaaaacttcctgatgtaggtgcaattccagacataatgcgagctgctctgtcaatttcatttgatagttacattggtcatgattggatggaagaccatgaagctcgttggttagcttatcagaataaagctcgtaaggttgcattcaaactcaatattctgaaccgaatcacaaaaggcggtgcagagactggtactttgaacgtattactcgccggtgtaaacgttggtaagtcattaggtctgtgttctcttgctgctgactatcttcagatgggtaagaatgttctgtatatttctatggaaatggcagaagaagtttgtgcaaaacgtattgatgctaacttacttgatgtatcgctggacgatattgatgatggtcatatttcatatgctgaatacaaaggtaagatggaaaaatggcgctcaaagaatactcttggtcgtctgattatcaagcagtatccaacaggtggggctcatgcaaatacgttccgtgcgttattgaatgaacttaaactgaagaagaatttcgttcctgatgtcatcattattgactatctgggtatctgtgcttcttgccgtattaaagtttataccgaaaacagctacacattagttaaagctattgcagaagaacttcgtgcattggctgttgaatctgaaactgttttgtggacagcagctcagacaactcgttcaggttgggatgcttctgacgtttcaatgagtgatgttgcagaatccgcgggtctaccagcaacagcagactttatgttagcggtgattgaaactgaggaacttgctcaacaaggtcaacagctcatcaagcagattaagtctcgttatggcgataagaacatcaacaataagttcttgattggtgtaagtaaaggcaaccagcgctgggtagaaatagctcaagaacatggtgaacaaccgacttcagtcaaagagacttccggtgctcagcaacgagttgcagaaggtaaccgaatgactcgtgttgaacaaaacgctagtgcaagagctaaactcgatgcattggctgaagacctcaaattctaaccgtttacacgcacatggaagtgtgttactattacctcatactaaacaagaggaaaacatcatggcaatctggacaattgaaaaacttatcgatgaaaccgctcgcactcacaaagcaaatatcctgacaacaccgtttaaagttggttctatagttcgcaaggctgaagacgcaaatttacgttgtgatggtgtaattcgtgaaattctagacaacggtggattggttaaagttattgtacccccttacttagatactagcgaccatgtaacgatgggtatctacgcagcaggtgattttcgtctggttcgcgctagcaattttgtatgcgcataaggcatgtggctctatttgaggaaaataaaatgaaaaaacttgtacttgcattaatctttgctgtatcatcctgctctgctgttccagctatggctaaagcagattacacctcaattccatgcatcaagttcgttgaaggtgactgggacaaagttaagcctaagctgattcatgaccttgaagctggtgcagataagaaccaaaagatgcttatcgaagacctgggtgaaagtgacctggtagtagctggcacaaatctgtattgtgaaaatgcttctgttccagaagttttagagtggattggcttatgatttttgaaggcagagaccttgtagattatcatgacgctgaattggctcagcttcgtttacggtttgaacgtgaaattgaaactggacttactcgttggggatttccggcagaccctcgtgaatcttatcgtaaaggtttaatattagtcgcaattaaaacagagcaggaaagacgatgcacacattcattttaatcatgactcttattagtgaacacggcggagttgctatgaatcaaattgaattcaagccaacacaaaccggcccaactgccgaagaactgtgtaaccaagctggtgaagagtggcgcacttctgctcgtgatttttcaacctctgctaaattcgtttgtgttaaacgataaatagaagaggagactatgtcaactattaaaagcagtattgatgccgtctatgcgtataagtttatccggctaatgcaaaaaccatttactgaatggaaagcatatgaagccaagataatcgatgaaaagggtacggttctgaagcgacctactactccagaagagaaagcggcttatacagctttccacgcatcggttcgttcaatcaaaagaatgttaacaactgttccaggactcaatggagtagcatccatgatgagtgcatggtctgcagtagcttcacgttacaatatcactgaatccgaacaaaaagagatatttgaggctcttcccttgttcgaggacatggtagccggagattccggtggaagtgtccagaatatcgcctctggtaccacaaccggagcaatcaccaataaaggtcctgagaccctaccaaagaaacgtaagcgcatcaaagtaaatctcaataaactgtgatataatggccttagaaataaggccaattcttttggagaataatatgtcatgggtcgacaatgaatttgcataccgcgcattttcacaccttccaagattcaaacaagtaacaaacggtcatcgttttaaactgaatttccgctgtccaatttgcggtgactcacaaaaagaccaattcaaagctcgtggatgggcatatgaacaaccaactggcggaattgtagtccattgctataactgtgatgcacacttaggattagctaaatatctgcgagaaaatgaacctgacttatatcgagagtacattcttgaagttcgtaaagaacaaggtcaagctcgctcagctcctaagaaagaagttaaacttcctccggttgaaaagaagttcattcaaaagcttgattattgtgagcgattagataggctttcaccggctcatccaatatgcaaatacatcgctggacgtaaaattcctaaagataaatggaaccgactgtggtttactactcaatggccggctctcgttaactcagtaaacgaaggtacatactcacatgagaaaaatgaaccgcgcttggttattccaatctttaatgaaaaaggcaaaattgaatccttccaagggcgagccctctcaaaagacgctccccaaaaatacatgacaattaaagctcatgagcttgctacgaaaatttatggtcaagataccgttgaccctaataagctcgtgtttgttatggaaggaccattagatagtttgttcatcaacaatgctatcgcaattactggtggttctattgagttgagcatggttccgtatgaaggtaatcgtgcttggattatggaccatgaaccacgtcatccagatacagtcaagcgcatgaagaagcttattgatgctggagaaagagttgtcttttgggataagtcaccttggtcttcaaaagacgtgaatgacatgattatgaaagagggtgctacacctgaacaaatcatggattacatcaacaacaatatcgaatcaggcttaatggctaagatgagatttactcggtatgctaaaatatgaacatagaacaacatgcctttcttaagttaggtgaagaatgtactgaagtagcaatgctttgctctaagattattcagtttggaattgactcagaatatgaaggcaaaactaatcgtgaaagattaatagctgaattaaacgacattatggggtgtcttctgaatttgcgagtgcatactgattttgatttcgtagaagacagagaagaagtttggaagaaatttgaaaagatggaaaaattccgcaaaatgtctgaaaaccttggattcgttgctaaataaagttaatgatataatttatttctgatttgacaaaaggaaaacacaatggctcactttaatgaatgctcacatctaattgaaggcgcggaccaagcaaacggtgcgtataatgcagtaattgataatcatcaagaccctctgcaagtaatgctcgatatgcagaaatctcttcaagttcgtcttgctgaagataaaccattcagtaaccgtcatcccgattctctggaaactgcaggtgaagtattagcttggttgcgtgctcaagacgactacatcgcagatgaaactcgtgaattgtacactgcactcggtggtatgagcaacggtgaaaaagcagcatctgctgtgtggaagccttggaaagctcaacatgtagaaatgcagtctaagaaaattaaagacttatcaccagaagaccagcttgaaattaaatttgagttgattgaccagttacacttcttcctgaataaaattatggctcttggtatgacagctgaagaagtgttcaaactgtattatctgaaaaatgcagagaactttgctcgacaagaccgaggttattaatgaaatttgattattacgcgtggcagaaagctgggagaccagcttctccagctgagcatagcacggcttacgctgacagagctcattggaagtttaacactcctgaagactatgtagctataaaatccagttttggaaaatgggttatcgcagccaaaggtcaatacacctttgaagttcctaaagagttctttaaacttgaaataactcaacaagagttcatggaacgaagcgaagaacttgttagtcttcatgaaagtttttctgatattgctggtagcggaaatacagaagaaatgaattcagctattgaaactatcagaactaaaaactttgagttacaagttgccagtattattgaataaataaacttgtaactaattaaaggagattacaatggccggttatgtaaacgtaaaaactttcgatcatcagacttctgctggcgaagtaaaaggtaaagaaatttctgtagcatttgaactgtattctgacgttcatcgtatcgctaatgctcactaccaggttttcccatctgaaacaccagcgtattctacggtgtttgaacgaaatcagcgtgacgagtggattgctgctaacgaaactctgtttgacgttacgccttctgaataataagtttagggactccttcgggagtcccttttttgcttttatagagtagtgtataatgacttcactaaatgaggaaaatattatgaatgttaaaacaactccatggcgtaaaccagtaggtgattgtggtggaatcagcgatttagttcgcttaaagtatatagaaagagaaactaacactgatttctttgtcgatgttaagctacatgcatacagagaagttggaacatctcttgaatgtgctattgaagttctgtattatgatttagttaaagttgatggcgtttacaaaagaaatgtattcaacattcaatttttgaactggagttattgatgattatgaattttatgagagggttattcggtaatcctcggccagatacccaaatcaaagctgaagaagctcgacttgatgaaagcatcaatcaacatatgtacggagctaatgatatggccgttgcatatgaggaaggcgcaaatgaacaacgtgaatggatttacatgggcgacggaatgatggaagaagtgatagtaaagaaagagaaagttcaacgaaatggacagatttatactggacgcgtaactcatactccagttaatcatcagaatcactctagttcatccagagcatcttattctgatagtccaatgatacatacaacatcatatattgatagtccctcaaatacatcctgtgacactggcggaggcttcacctgtgactgataaacaatacaaaattactacattcggtttggaatttgtttctcgcgattttccgtcattcactgacaaaagacatcctcttcataaaagggaaattatggtagctatctgctataatccatttttagaatatggaactagtcatcgtgataatgttgacccaagtgaattgaaaaatggttggcctgaaggtgttgatgttatcatcaaagaatacaacacttatgttaaaaccaaaaactctccatttgatactcaagacagtttcttgcttggtggttggaaaattccacaaactaatcttattgacattattccagaacccaaattcggtgttaaaagtgtcgatactgtgaaaattccaaatatgatgcatactgatgaatacggaactatgaattttaacaattggttaatcacagaccagtttgatatgattctttttcgtagaggtatttggcatctattgggtgttcctaaaacggaggcacttccgcgttgagtaacattttcgatatgtttgaagaagacattcctgaaggatatgtcgaggttgatatgaaatctggtccaaaggtggaccagagtatcgctactgagctagaactaatcttcaaaaagcatggggtagattacacaaaacctttatgtgaagaactgtcctcactgtgggcagaccctccgccttgggctccctgggcaaaataaccgtttacatcccttctcttctgtgttatgatagcttccgtaaaacaaacggaggttatcatggcatcatttcaaagtcctgtcattgaagtagaaatcacaccatcaataccagttccttctggtggaatctatgagtattgggaaggctcagaggaagttgagcgtaaaatgcttgagtctgaagttaactcgatgttcactgatgaagaacaagcagttctatggaagtgtttgaacgataaagtggaagactgggttaatcgtgggttggataaagttatccgccgtcgtatgacaactgctacccctgaagtgctttatcgcggtgtcaacagacgaatgctcaatgttcttcaaaacgtcgaagttggagaggtttttacatctgaaagagttataagcttttcaaccgactttaacacagcaagaagttttgctagctttggatgctatgggaccaagaccatcattcgctggtctaaccctacgatagcttataactatcaggaagatatgctaaagattttagccgcagctccaaattgtgagttcagcgcagcaccttacgaccctttagcaaaaattgaccgtaagaataaaattaacatggtccaggatgaacaggaatggatgatgccaatcggaacttcgttccgagtaactagcattgaggatgtggatttcaatccaggtggaatgcatacaatctatgatgtagaacttatttcattctgaccgtttacaaccggaatcagatgttatagaatactccttgaaaccattataccgctactttcgcaaaagcatataaggatatcatatggccaagccattagaaattgtcgttgcaactcgtttagttaatacttacgcttcagcaacacgccgccaaaaagattttggattgactatggcatatcttgctaacatcgctcaacagaaagtgtgcgcttactcaggtgagccattctgtgaaggtgtcaacgatgacatgatgactcttgagcgttttgacaacgacaaaggatatgtgccgggtaatgtcattccagttaagaagaagtacaactctgctcgtggaaacttctccttagaggagctgattgagaaacgagatgagttagcttctcgtattgttcgtgctgcagatgcgggtggtcacgtcattgtcgaccaacaagaaccagaatctgaagacccgctggcgggtatcgccaaaaagtaccacaagcagtacttggctattctgaacaatatcgctaaacgtgaacagcatatgaagcaaaagggtgtcacggcggaagtgaaaaagtctttacaggctcgtatcactggcggtaaagctgaacttaagcgtcttcgtaaagtttctgggaacactgacaagctggcttcaaaagctgcaaccacaagtaaaagggctacaaaagcagaaaattctgtccataattatgatatagtaattaagggattaactcgcttccagaacttatcttttatagataaagctaagctgaataaaggtctcccattatctgcttcaatgtttcaacttattcgaggtaaaatgtgatgcactatggctacgcgctgattacaaaagataaagatggatttgagattccattctacgaagcatgggatggaaatcctgttggtctttgctttatctttacaaataaaatttcagctgagaaatatatggggactcagcttggaaaactccagcatctgttggaaaatggtcgtcaagtagagactcaagtaaaaaaatggcttttcttcaaacgtgatattattgaacatataccgctcgctgaacaagagcgccgaaatgtgcaacaaatgattaacacattacaggttaaaaaggttaaagtcgcgtaggagaagttttgaatattacatttgatatgctcaacgaaggccagaaggctacgttcaatcgtgtagttgaacgtattaaagctggtcgtggtagtcacatcactattaatggtcctgccggtacaggtaagaccacgatgacaaagttcatcatcaattatttgatttcaaccggagtatcgggtgtaatgctggctgctcctactcacggagctaaacgagtacttagtaagcttgcaggtatggctgctaacactattcacagcattctgaagattaacccgaccacctacgaagagaacatgctcttcgaacaaagtgaagttccggacatggctaaatgccgagttctaatttgtgatgaagcttcaatgtatgaccgtaagcttttccaaattattatggccagtgttccaagctggtgtctgattatcgctatcggtgataaatctcagattcgtccagtagaaccaggaagcactgttccggctctatctccgttcttcactcacaaagattttgagcagctttatcttactgaggtaatgcgaagtaatgctccaatcataaaagttgctactgacattcgtaatggtgagtggatttatgagcatctcgtagatggtgaaggtgttcatggctttacttctcagaccgctttacgtgatttcatgatgacatactttgaaaatgtcaaaaccatggaagatatgtttgagaaccgaatgttagcattcaccaacaaatctgttgataaattgaactctattattcgtcgacggattttccagacggaagagccatttatcgttggtgaagtagtagtgatgcaggaaccactcatcaaagagttggaatatgacggtaagaagttctctgaggtcatcttcaacaacggtcaatatgttcgtattctttcgtgtaaagagtcctcagatttcattggggcgaaaggagttccaggcgagtacatggttcgtcattgggatttagaacttgaaacttacggcgaagaagacgattattacagagaaactatcagagtaattgctgatgagcaggaacagaacaaattccagttcttcttggctaaagcagctgatacttacaaaaattggaacaaaggcggtaaagcaccttggaaagacttctgggctgctaaacgtcgttatcataaggtgaaagcacttccatgctcaaccttccacaaagcacagggtgtttcagttgataactgctatgtttacactccatgtattcatatggcagatgctgaattagctcaacaattgctttatgtcggcacaactcgtgctcgtaaaaatgtttattatgtgtgaggcttatgtacacaattaccgttaaagacgccgaggctattgtagccggcgtcaaagataacatggtgtcaaatccatctactacaacagaacgtggaattaacatcaaaggcagtcagattgtgttagaattaaatgacattatccgagatgctaaagctatttcgtggtatactggatattatccaaaaattactctgtctgaatttgttgcaggtaatatccgtgaatttaaggaaatgacatgattaaagactttattattgactgggagacgttcggtaacgtctcccgttctgctgttattgatgtggctgctgttgtatttgacccgaacccggaagtagttgaaacgtttgatgaactcgttcaacgtggtatgaagctgaagttcaaccttaaagcacaacaaggtgttcgtctgtttggtgcttctactatgaagtggtggaaatctcagtctgaagaagctcgtaaaaacttgcttccatctgatgaagatattgaccatgtcgaaggcctgcacaagctgcttcaattcctgaaagacaatggtgttgacccatggaaatctttcggttggtgtcgtggtcaatctttcgacttcccaattcttgtggatattctccgtgaaggtgaagctcgtaaaggtattgctgaaaaagatatcgatactttcggcttagagccttgcaagttctggaatcaacgagatattcgtacagcgattgaatctctgcttttaactcgtgacttgacgacaactcctcttcgtaagggtgtcctggatggtttcattgcacatgactctattcacgattgtgctaaagatattttgatgttaaaatacgcccaacgttatgctcttggtttagaagatgcaccggaaggtgatgaaattgaccctctgtctttaccaaaaggccgcggttaatctgctttaacttaatgtgttagaattgaattctcttaaatgaaaaggtgataagatggctagtaaaatgattggtaaaagtgtaaaagttattggcggccagaacaaaggtttggtcggttggattgtctctgacaacgtagcccgcggtcagtacatcattaatgttgcaggtcctactcttggttcaagtggttttaagatttctgctaagtatcatttcgttgaagtaaatgagcccattgatactgcgcttgttaaagcaaaagctaagtttgaaggtaaaccagtttcagtagatttgaaagatgctttagaaaattcaagcggaaaagatattaatggtatgggtgcttgggtatctctggtctatcgtgatgaagatactgaccaaattgtagccaacgtagtgtttatgggcgaatacgctgtagttcctaccgataacattaaccatgtaatggctggcagcgcccgtccgggacgcgcataaactgtttacttttccagagggctatgatactatagccctatcaaaacaaacaaatgaggagaaaatcatgaaaaaccaacctatcattaccggcatcactcgtgacgaatttgaagatactctgtacaacccagacttagtagtagttcagaaagatgttacgggtcaccttgagcacacccaaattgcttatgtttatgaaaacgctggtgacgctctaccaatctatggtatgttccgtcaaatctctaatgatggcacagaatactggaaggaaacttactaatggccacagaatataagcttggattaacttaccgtcttgacccagaattagaagattcatttgttaaattagagccgtataacgaagatattagccgctttattgaaattcatggaggctcatttactgttgcggccatggatggaaaggacgtttctgaggctgtaatggcagatggaactcgttcgccagagttcttttatctttatgataaagaatctaattattttgatgttgtcgaaaaatcatcagaatgggttccaggaacagtatatcgttgcaaagatttgcattcttttgttgctcttagtccaatcaataagcgctgggctttaagtgtaggaacaaagccatttactgtagaagttgttgactatacttgtggttattctcgcactaaaagaatttcgttccgtgacgtaactggaactcttcaagtgcttaatttcgctttagttaaatctgaacttaaatattttgacgtagttcatcctggatttattaacgaacactttttcgaagatgaagaaatgactcttgaagatgagattgaaaatatttctgaagctgaagagtggaacgcagaagttgaaggcgtgatggtgttcaaaatcgaaagcgaatatgaacgcaagaaagctattgaaattcttcaaactatgaaatggaagaaataatgcaagtattagatatcactccggtacttcgtgtttcggctaattataccgaacgtaaaccatggcgcaacattgcatctgttatgctgcagctttcttctgaaactggtgaaatgtgtgactggattaatcgtccttatcgccagaaagaaatttttgcaggtgaatgcgctgatgtaatcaactgcgtaatcgatgctctttggctccacatgcgcgaaaatatggatggagcttctcatgaagaagttgctctggctgttaccgaagagttaaatcgccaacttcatcttaaaactaaaaagtggtcggaggccgtcaatgccattgtatgattatcagtgcgaagcttgtggtgaaaaatcagaaaagaacgttaaaatttctgaacgcgataatccacaaccgtgtaaattcttgaattgcgaaggcgaaatgaaacgagtagtttcagctccagcagttcattatgatggacttaagagtggtgattactaatgggtactcgtccacgtattcgttttatgaaatccggcgaaagccgggttattaaactccatagcggcaaaattattaaggtgactaagaaatgaaatatatcaatcgtactattgtagccgctttatttgcttttggcgtagctggatgtactgatgcagataatgctactcgcattcttgaagcaaatggtttcactcaaattgaaatcactgggtattcttggttctcctgctcagaaaaagatactcaatctaccggatttaaagcagttggtcctaccggagtgaaggtagaaggtgctgtttgttctggcatgttattcaaaaactctactatccggtttgaataatggaaattaaaaagagtttcggtaagcataaacactttgatcgtatgacatttatgacgtccgtaaaagtaggacgtcgtactattacgagttatacgtgtgctcctttgacaagaaaacagcttcgtcaattgaaaagaaatgctcgtaatttagcttcatctggcttgttcccacacgagcacaaaatgttccaatgtaaaggctgcaaaaactgtaaataaatatatgtagactataaggagaacattatggctacagatatttggaccacggtacatcctattccgtggcgtaatacaagttttctttaccttccttggtggattcataacatccttattaaagccaaggaagaaggtaaagactggcgtgaatacgctgaccctcaatatgcacttcaaattgatactctcaaacaagcttatgtagattacggtgaagttaatttcattgaatctaaaaatggctatcaatacacattaagcgaatatactgtagatggtccagaccctcagccaccgctgggaccaatgcttcaacctgttgctgtgatgtcaaatccgcctactcaaaaattgcttaaaggtgttggattatctggaactgctacgatagtttctggtggtactggatatgtatttggtgacattgttgatatccctggtgcggaaggagatgttcctggacagattcgagtaactgctgttggtagtaatggtgaaattacaacagctcaaattcgcaaacctggtgtatatgcaactgctcctactggtgaaatttctgcaactggcggtactggtacaggtgctaaattcacagtaacaactaacgcaggcgtagcttcaacaatttatgctggtgtaacaattgctcgcacagattccaaaataacttattggggttctgatatcaaagacgcggttgcaggcttcagaggaaatggtactggcaacggaactcaatgccgagttaatttcaaaactgattcaagcaagattgatttcaaactcgccgggaataactccaagtatgacctttatgtagatggacagcgcatctctgccacttcagttaccactgattcgtctggtgcagtttacatctatagcatcgattggaacggtgttgagcaaatgcgtgaatattctcttgttggcgtgaatactgcctttggcggaatttatgtagacactggaaaaactatcactgcaattactcgtccagctaagatgatttggcagcttggtgactcttacacattcggtacaatggcaactcaagcatcgttcaacgatttccgtttctattgcgataagcttggtttagtcggattagctgatggcatcggtggttctggttggacttcaacaagctcaactcagcctcaagctcgtatcacggctaagcttgcaactctgagtttcactccggatatcatcactttagctttaggctataatgatgctccagccggtagaattgatttgctcaaaaccaacttcagagagtcaattgctctgattaagcaatatcagcctcaagctaaaattatcgtgtttggaccagcaactcctcttggaatgactgaccaaatcgcggcagttcgtgacgcactgattgaacttactactgagttagacttagagttcgtagatgttaaaggttgggttactgcagagaacgcaaatctgtatacctcaagcgataacgttcatccgaatgaccaaggttacttctggcgtggttcacaattcactaatgttctgcaagacaaagtataatgaaagggccttcgggccctttgttgtttactttctctacaaagtatgataaaatagctctacaaagaggagaacagtatgagattcggtttaactgtagagcataaaaatttgctcaagcaactcaaaattgtgaacaatgcgcttgggcgcaggaagtttgctttatggcctacccgtatagtcgatggaagctatatttggcttgaaaagtattatgagattcgtcatgagcatgttcatcaaaacgaagacggaagctatgagtgcgaagcgtattatggtgttgatatatacgcatatacgaattttcgtgaagtgcgccataagttctataaaaagcgtcgtgaaaagggactgtatagcatgtataacccaacctatgatgcaatttatggtgaagaagctaaaactcatttgttacaatacaaagcagaacttgaagaaaaaatctctcggatgtaatgctttaagatttgaatgttagaatgttcacctaaacgaggacaaatgatgattaagaacgaaattaaaattctgtcagaccgagagcatatcattaagcgctctggtatgtacatcggctcttcagctatggaagctcacgaacgttttctgtttggtaaattccaaagtgtaacttacgttccgggtgtaatcaagctgattgacgaaatcattgataactcagtcgatgaagcaattcgtaccaacttcaagtttgcaaataaaatttctgttgagcttaaaggcaataaagttatcgtaacagataatggtcgtggtcttccacaagctccagtagtcactccagaaggtgatgaaattcctggaccagtagctgcttggactcgtccacgtgccggtggtaactttggcgatgatgctgaacgcaaaactggtggtatgaatggtgtcggttctgcactgactaatattttctctgtaacttttgcaggagctacttgtgacggacacaacgaaatcatcgttcgatgctctaatggggctgagaatatctcttgggatagtaagccagcaaaggaaaaagagttcattcaaaccaagaccggaactcgagtatcgttcattcctgacttcagtcacttcgaaagttcaggacttacagaagtagatgaatcaattgttcttgaccgtcttcaaactctggcagtagtattcccggatattgaattcaaattccaaggcaaaaaagtcaatggcggattcaagaaattcgctaagcaatttgatgaagaagctattgtagctgatgaagataattgttcaattgcaattggtcgttctgatgatggtttccgccaactgacttacgtgaataacatccatacttctaagggtggttctcatgttgatttggttgttgacgaattgtcaaatgaacttatcccaatgctcaaacgcaagtacaaattggaagtaaacaaagctcgtatcaaagagtgttttacttttgtgatgttcgttcgtgatatgagcaacatgcgatttgattctcagactaaagaacgtctgacatctccgtggggtgaagttaaagctcatttgaatttggactacaaaaaacttgctcaacaagttatgaagtccgaagcaattcatatgccaattattgaagctatgttggctcgtaaattggcggcagaaaaagctgctgaaactaaagctgcaaaagctgcttcaaaagctaaggttgctaagcatattaagccagaactttatggtaatgataaagaagaaactactctgttcttaacagaaggtgattctgcgattggttatcttctgactactcgtgaccgtaaacttcatggtggttatccacttcgtggtaagttcctgaatacttggggaatgactgcagcagaagcaatgaagaacaaagaagtcttcgatatctgtgcaatcactggactgactattggtgaagattatgaaaatctgaactacaaaaacatcgctatcatgactgacgcggatgttgacggaacaggttcaatctatccaagtcttttggcattctttagtaattggcctcgtctgtttgaagaaggtcgaattcgcttcgtcaaaactcctgttatcattatgagtaaaggagacaaacagaagtggtattacactgccgctgaatatgaagctgaaaaagatgaacttgctggttggaaacttcgttacatcaaagggctcggttctttggaagaagacgaatatgaacgagtaatccaagaacctcattatgatgtagtttctcttccggaaaactggaaagaactcttcgagatggttatgggttctgacgctgctccacgcaaggtctggatgagcgaataaatatatcgggcgtcttgcccgatacaataaggagctattatgtcacagatttgggtaacattagtagatggaagttacggctacatgtggggagatgctctgccgctcccaggtgatactgtcactatccgtgtaagacataccaacggctcttatactaaagtcacaggcattgtttctcgtgcttcgtggtaatgattagggactccttcgggagtcccatttttatgaggtgaacagatgattcttgatgatggaactttggtaaatcttgaaaacgtagcagaatgtatcaaacagaacggagaacgacatctaactgagcatggaggttcaccagatgacccctatcacattaaattcaaacaggcaatagattatattgttaactgtattgaaactcgccagaccattcctatgaaccttcggacgttcgcgttgaaggtggtttacaatcgccgagaaaagtatacaataaaacaaatggcgaaaatccttaactcaataggaactatcaaatgttaactttaaaaccttctgctgaactgttcgacgatgctatctacaaagagtatcgtatcattcaacgcttctttgacattggagaagctgaagaattcaaagagcgctttaaagaaattcgtaataaaatttttatcaccgatacggctactacggaagaacttctggatgtagctaacctaataaaacgacactgtgactgagaaatatgaaattaattgctgataatgaagaagttttaggttctgctggtaagaaaactaaattcaccattcaggcctctcccaaggcctttatgattttgtctgataagctctataagaataaaatccgtgctgttgttcgtgagcttacaactaactggcttgatgctcacattctgaatggaaagcaagacgttccatgtgaaatcaagtgtccgaataagttagacccgcgattcattattcgtgactttggcccaggtatgagtgatttccagattcgtggtaatgacgaagaacctggtctgtacaatagctactttgcttcgacaaaagctgaaagtaacgatttcatcggtgctctgggtcttggttcaaaatctccattcagctacacaaagtcattcactattgtttcttatcacgaaggtgaagctcgtggttatatggctgtgatgaacaatggtgaacctgatattcgtcctctgtttgttgagccaatgaaagaaggcgagcagactggtattgaaattacggttcctgttcgtcttgaagatgtagaaaaatttgcgtatgaaattgcttatgtaatgcgtcctatgccagttaagccaatcatcactggcgcaagcattaacattgaatctttcccacaagatgtagagtggttccattctcctaatggatttggaaaagatagtcgtggtctgtatgcggtttacggtaagattgtttatccgattgaccaattccaaggccttgaatgttcttggcttctgaatcgttatggatgcgtttacgtcaatttccctcttggcgaattggatatcactccatcacgtgaagaactttcgctggacgatgtcacaattgagaacatcaagaaacgtgttaacagcttagaaaaagccactcttgaagctgatattgcgcatcttcagtctattgagaataagcgtgagttagttcgtcagctgtctcaatttgattcaaaccagcgcgctattctgaatcgtcagaacatcatgtttggtgataagacttatgctgaatggtgtaacgcttataatactgacaatattcaaaagaaaatcgaagatgcaatgatttatacttaccgtgtaaacattgattctgagcgctggcgtttaacatcttcgtggtccacaagaaagcgtatgtcggtgacaagtctgctgaacgttcagaatgataaagtgcatatcatgattgatgataagccttcacgtcgcgcagcaatgttccgcggaatgtatctgaaagactttcatcgttatgctaacttcattatgcttaatccagaagaacctaagcatatgaagattaaagatgaaatcgttaaactgtttgaccaagacgaaatcattattctgaagtcttctgagatggaagaataccgtaagtttgagaaagagcattactcaaactcatctaaaggtgatggtggaccgcgtccaaaatctccaaacggccaattgcataagttagatgctaaaggtggttggtggacttctgaagacctattcatgaataaggacgatattgcggaacttgaaggttatgcaattttccgttcacgcgatgagattcgtacattccctgaagagctgtactggtctggaattgatattgaaactgtcagaactttggctaaagaactaggcgtaactaagttttacgttattcgtccgaactcggccaaggttgctaaattaaatgataatcttgaatcgttggaccgtttcattgttgatgaattcatcaagattattgatgacctggatgctgatgaatatctgccatctacattctttaaccgtcgtgttgtaagtaacatcatcaatactcctgagttaaagtggctgctgaagttcattactggcaaagataacggtgagcgagtatctcgtatcaatgaaatcggacgcaacctgaagaacacttatatcacggcaagtcctgatggttcttcacagattcgtgaagatttagctttatgtgttcggatttataataaactcacggatgctgcttcagctgaagtagatgctgcattcaaaaagtttgagaaagaatatcctgtcatcgagcatatgctaaacgaatggcgtgtagctaattatgccgaagatatttcccgtattatgagagcgctggaaagcgctccttccttaaaaggtgaaagtgaagatgagtaagaaagtctctgttgttaaaatgtttgatgcagcgcaaaagcgtgaaatctatgatgcatatatgggtggttacactcaggaagaagtcgcaaaattcttcagctgttctgttgacacagtgcgtcgagtaatcaaagaaattaaagctgctagttcagttggtattgaagctgttgttggtcatactgaagccgcaaaaattgcagaaactaatgcaatcagtcaagctgcaactaatccattcagaccagaagatgttgtatgggccggttcttctaagttcctgtctatcacttatggtcgtgatacctatgcagcagataaagaccatccgaacttcaaacaagctcttcagctgtgtgttgatggcgaatttgaagaagcaattaatctgattaacattgagaaggcaattacttcttatgttgacggtaacattcgcattgaaaatggtcagctgttctaccaggacattgaaatcaaatctggtctggttgaccgcatcatcaatgatatgcagaatggtgaagattttgaattctatctgccgttcctggaaaatctgctggaaaacccaagcaaaactgcagtgactcgtctgtttgacttcctccaagctaacgacatcgaaattactgaagatggccatttcctggcatggaaagttattcgcaacgattacactgactgctatactggtcgttttgataactccgtaggccgagtagttaaaatgcctcgcacacatgttgttgaagatgaaaatcgtacctgtgaagctggtctgcatgtttgcgctcgtagttatatcaagcacttccgcggtggtaatgaccgtctggtggttgttaaagtacatccgcgtgacgtagtatctatcccggtagattataacaacgctaaaatgcgtacttgtcaatacaaagtaatccgtgaagcggaatacaaccaagaaactgattcttatatctaatgaaagggccttcgggccctttatttttgaggaagatgtcatgattaatccattcaacgtaagtgactctgcagttgttaatcttcgtggcgaccattatgctaaatcagtttattgccgtaaacttataaagcatccaggagatgttcattatgcttggttacattgtgacgaagtagttaatgaaatccctccagttgacgcggattatctcgaagaagatgaccgtatttattttggtgaactacatatcagaggaatttatggaaaagacgaatcccggcctagtgagattgaaaagcctgaagactttttaccgggcgttcagtgatttaactccagaagatagagtcaaaatcaaaagtactgctgcttattctcttcgtcaagacccagaccaagataaaactgctgtaataaatcgctgtgcaattgcacagctagccgaaaaggcagtagctgattggatggatggttatgttgctggtggtcaagaaaaccatgatgacccttacacgtatgcatgggatgttcttgctcatcctcgattctgtggtctacgcattgaggtcaaaactcatcaatcaaataaagattggatttcagtcaccactggttactcaggagactatcctggtggctcaggaataaatctaggacccttcttgacacatagagtagcagactgtattatcatattagatgtggtagaaagtgggcctagtgtttaccagtttaccctaaagtttgctggagaccatgaagacctcaaatctaaagttcgtaaaagcaactaccaaggctggtttatcaacatccctcctaacagttaatctctgccgtttacattctccgttagatggtatactatagactagaaatcaactaacggagaataatcatggctaaattcaaatatcttaagcataaagaaactggagaaattgtaatgatttctcaatcttcaactgaaggcggttttgactgggtggacctttgcctttcaaactgggaccaggaacaaccttggttcctgacagcttatgaagcagaacgtctaataaatggtgagtacaatgatcattatggttatgatctcactaaagaccttaagaaagcaattaacgctggattgattgaggttaaagaagtagaactttaaccgtttacattctccgttagttatgttatgatagtctcgtaatcaactaacggagaaacaaatgaacatcatcaaaaagattatcaaagctatctggactttaactcttctgatggtgctctttggagcctttgcattcgctttagcacatgatgtcgtaatggcatggattaacttctgaggaaaatattatgggtcgcaaaatttatagctcgcgtatggataaaatgcaaaagattttctggattttcttttctatcgtagctatcatgatttttgttggaattggttttagcatctgggctactgttgaaatcgttcatgtcattcaaactgaaggtttgaaaggtgttgcagaagttttgatgaatggtgttcagcaagggactgaattatgaaaatcttaaaattatggtacacgggtatcatttttactacagcggtttacgttgggttcaatttggcatattggcttggtttaagtagttatgaattagtgtttgaaattgttaagcactaattcagggccttcgggcccattgaggataaacttttaattgattgaggaaaatgatatgcgtgattacatgactcgtggtgaccttgaagctgttggtgcaactgttgtgtgtactgttaaaaatggtgaaactgtagggtatgttgacccatctattctggctgaacctggtttctacttcatggttaaaggcgcttcagcttggcgtgcagtagcagcacgattctacgttggtcgtcaacgttcaaaatctggctttatgaatgttctgtcgcagattcgtcagggtcgttctcagcttggtcgtactatgcgttcaaataacgtcatctacgatgtgtacttcgttccggctgataaaatgaagcctttgactactggttttggtaaaggtcaattggcgctggcattcacacgtaaacataacgattcttatcagaacctggaagaaatgaatcgcatgttgaatgataacttcaaatttattcttcaggcatattaatatgagtccgttcaaacagatttgggctttggtgttcttgctcatggctccgcttttcatcgcttctggtctgtttatttgggaggggttaacccctccgccaagagtcattggaagcatgtgctttggtgtagctgcattagctgtagaacgtttgttctattacacaggcttaataaaatgaaactctcaataggcgttattggtgtgtcaatattactctccggcgctttagccggagcagtttatgtgatgggcgaaatagtgctttttcttgctcgtgttatgatgaacatcggtaatttaatctggtagggtaatatgacaactatttttgacatgatgtctaaacaactcgatgactctgttggtcaacttaatgtaagaaaccttcaaagcatcattgacaatgaagccaaagaatttgcaatctatacagtagaaaaccgtgcaattcctaacttaattgatggcttcaagccagttcaacgatttgttattgctcgtgcgctagatttgtctcgtggtaataaagaaaaattccataaattggcttctgtggcaggtggtgttgctgacctcggttatcaccatggcgaaggctcggcacaagatgctggcgcgctgatggctaacacttggaacaacaactatcctcttttggatggtcaaggcaacttcggttcacgattggtacaaaaagcggcagcatctcgttatattttctgtcgtatttctgacaatttccgtaaggtctataaagacactgaaattgctcccgaacataaagataaagagcacgttccaccagcgttctatcttccaattattccaaccgtccttctgaacggtgtacagggaattgcaactggctatgctactaagattcttccgcatagttttgaatcggtagttgaatgtactaaattagctcttcaaggaaaactggataaagaaccagaagttcaaattccacaattccgcggtgaagtggttcgtcttgaagatgggtcaattgaatgtcgtggtctttataagttcacttcagcatctcaaatgtacatcagtgaaattccggctaagtttgaccgtgaaacttatgtggaaaaagtacttgagccaatggtagataagaacttcatctcttatgttgatgattgttcaaagaccggctttggctttaaagtgaagttcaagaaagattatatgcttggccaagacgatgagcagcggcatgagaaaatcatgcgtgacttcaaattggttgagaagatgtctcaattcatcgtggtcattgatgaaaacggaaagttaaacgataagttccaaagttcttctgaactcatcaaacactttgtggaagttcgtaagacttacattgtcaaacgaattgaacacaaagtcaaagaatgcgatgaagcattcaaattagctttggctaaagcgatgttcatcaaagaagttattgaaggtagtattgtcattcaaggcaaaactcgtaaacaactgacttctgaacttgaatctcgtccaacttatgcaccatttgttgacaagttagtgtcaatgaacatctatcacatcacaagtgacgaagcaaagaaacttgctcaacaagctaaagacctgaaagctgagctaaagtactggcaagaaactactccagaaatcgagtatatgaaggaccttgaggctctttaagagcttctgtatcactctaaacggctctagttaattctagagccgagtccatataattaatcatcctttctacgcacattccctcaaccgttctggttaacttcaaaaattctttcaatcaaccgtttacatcatcgtttgcttatggtattatagctctatcaaaaccaaacggagtaaacaaaatgatttcaattatcgttgctgccttaacaaatgctggtattatcgcggaaacttctgatttcgcttatgttaaatttaacagaatgtcaattgacaagaatactcaagcacgttattgggctatggtttatgaccataatgaaagtcaatacattttaactgaagttctgattgatttagaaactttagaggcagatttcgcaggatgccctgaacttgaaggcgaatttgaagaagtcttagaagcttatgtttcaaaatgaggaaattatggaaactttaatcaataacttaaatgctttactggctaactcaggtgttgaccttgatgatgcaatgcatgcagcacgccttcactcatcaaacactgatagcaatagctatctgacaatttggtataacagcgaaagtgaaaactacgtgctggtatgggtatacgtcaacaactatgacatgactgcagtgcttgatgcagaagttgaagatgtggcagaaactctgaacgaagcgaagaagctcttcgcagacttcttccgaggttaagctgtttgatagcatctttttctgaagatgctaaactaaccgtttacatcggcttaaaagtttgatactattatctcatcaaaacaaatacggaacctggagaaacaaaatgtctaaagtaatctatatcgttaaagcttctgaaaactctatctctgaaaatgctgcaaacgttttgattgcagtcgctaagaaagacttcatcacttcttccgaaattcgtgacgttctggcagataaactttcagctgcttcagttaacagcaacatcggtgttctgattaagaaaggtctgattgaaaaatcaggtgatggtctgattgtatctgctgaaggtcaagaaatcatcaatcaggcagcagttatctacgcagaagaaaatgcaccagaacttctggaaaaacgtaatactcgtaaagctcgtccgattactgaccagatggaagcagacaaaaatatgatgatggagcttctggcaactaaagataatctgttcacaatcaaaaaactggatgtttatcgtagcaacttcatcgcggtacttgaaaaacgtactttcggaattcgcagcttcgaggtatcaaacaaaggtaacttccgtatctccggttacaaaatgactgaagaacaagttaaacacttcgaagaccttggaatggttgctaaacattctaaaaacggcaatgtatacctggacattccacgcactcaggaaaacattgaaaacatcatccacgctgttgacactctgtaataaggaaattgaagatgaacatgaacatgaaaaacctgaatgctcaaatcgaccgcgtcaaaaagtcaatgaatcgtccggcgattttgaatgaacttcaacgctgcgctgaacgagtaacagatgaacattacttaccaacagaagcatgggaagtctggttccgtggaacacatcttggtagtattgaacgtaaatacaaaggttgctatgcagttcacagttctttaggtcgtcactgtggtgattgtgcaacttatatgcaggcgttggctcgcttcattgattcatgttctgttgtcatcgcaaagaaagagcttgaagaagttgaagaatggattaacgaagtagttaaagaacctgaacttcgtgtttggggaatccgtgaaccaaaatctctgtggcagaaaattaaaggatttttcaaatgaatggtgatttaatcgaaactcagaatatcggtgaacgtattcctgaaatctgtttcgttaaagctgactggtgggatggtcgtttacttcaacgagttatcgtctgcgcagctaatcgttttaaattgaaagatagtggagagttagttattccagggactcgtcattattcaaaagatatggctctggtgttagaccaaatgcgtgataaggtggtttctgagcaggtttatggtgatgaccaaggtttcttggaccaatggggaaattatcttactcgcaaagaagcattaatcgtcgcaactcatgccggtcaaattaatactcgtcgtcagaaaggtggacctgctgatacattattctccgaggatttatactaatgaaaatgaatattaagttgcttcaaattgaatctctgcgtaatcaaatcaatgctcttaaaaaggcaaatgaaatgatgcatgaacaatggacttcgttaacaaacgaatccggttggtcttggttatcagaagctgttgtgaagaagctgacaattaacaatgacccatggatgtggaatggaactattaagccattgtttgcacaatattatgttatgcttaaccttgaaatgattaaagagcttgaacgtcaaattaagaaacttgaggaacaagatgaataatccagtagcaaagcatgatttcaataaaggcggcgctcataaagatatgaagcgtgccgaaaaagaatctcgtcgtaaacaaaagcataaaggaaaaggttatgaagattagtactcgtgaagttgaaatggtgacttatcgctcagaagagctagaaaagttcaagtcgcaatttggaatgtgtagccgtatgacttatgaaatgctagaagaaattgataatgacattgaatcagatatcgatgattctcaattcattgttagaactcgttctaacggtacaatggatatcattgcaattggcgatgcaccaattgattcagctattcaagaaattgaaaccattatttcaaatttgacggaaggatattatgagtaaactttctcataccgaggcagaacgcaaagcgtgggatgaacatactagcgtcgtagatgctataactccagtgtatcatcttgtagtatggttctctttgactcgagaggaccaagattgctcttggaaatatttcgaagatactaccttccaaaaatttgtcaatgcggttaatcatccagaatctctactcactcattgcgaaataaaagcaagtgaagaaacattttgttatttcactgtaagttctaagcgtagtgtttctgacgtcatgcaaggttatcaatttctcaaaggtgttgctgacgaatttgaattgaaaatcaattacgagaaaatttaatgaaccagacagtagagattcaacgctatctcgaaggaatgatgaacaagcttgcacttggtgacatggtagattacagctatcaagaggccatggagatttgtcactggatgaaacgtagggttcgtgtagtaggagccgaatggtatatatcagctgagttgattgatggtcgctacgccattcgctatgactctggtgacgaatacgtaactttacctggccatgtacttcaacgctgggaagtggtgaactgaccgtttacattcaccgttgactgtgttactatatcctcaatccattaagtcgtaggaaatacttgatatgtctaaaattgaaattgttcgcgaaattgttactgtggcttctgtattgattaaatttggttctgaacacattcttgaaaaacgtgaacattttattgcatttttgaatgaaatcggaattaagaatgatttaggtcgtcctctaaatcagagtaacttccgtaaaatgattgaagaaatgacagctgaagaaaaacaacagctagttgaagagttcaatgaaggttttgaatcagtgtatcgttatatgatgatgtatagcaagccgtaacatccttgttacttggctcttcctaaagttcttgcagcttgtccacaaattgcagcaagcctgtcttcatttaagagtggtttgctataccagtacatggaaactgtcccggcatatacattgtccaggttgaaatacggacatgagtacatgtacttcaactccccatcctttttcttagtcggcaagaaaacaaattcattttcagaagagaaatatgcacctctcaaatgagcagaatattcgtttgaagtcttatcaactggaaatcctcctaaatttttttcattgaccgcgctaggcagtcgcccttcatatgcaattaaatctacaaagtagtttaagttgcgtggtctaaacgagtaaattgcggaaaaatctgcattgctcgacacgtgcgctatctgaagttgttctagagctgatgcttcaaatttagcctctttatcttgttgcaggactttagtgtacgtctcgtaacgagactctttccacacttgcataatagaatctaaacgataccatgtaagtgaaagaatgaaaacaactacaagcgcaacaacccgggaagcgagtaccctcccggttgcgttatctttgaagagccggtctagaacaccaaataaaatgtcagatattcctggtagtggtgttctctgggtcatataccctccttttcaagggtatttatgctttaaactcttgagtaaggttggagcatttccataaactacagctatgtcaatataagcgtagcctttgaccgcttagtgcgctaatagatacattagctttatctacgggttaacaatccttctagcacagagcctgttttagaattcaaataatcataccaagctccaacttggctctcgactatttgatattgtctatatccgccatccattcttccatcagtcccaaaatcaaatgctcttccatcactaaaagtaaggcgtaaatttaccgcagggccgttttgaattgtcacaacactaattctttgaagattctggacagccacgcaagtccctaaagcgagaccttcaaaattgccttctatcgctggatagccggaaggtttagatgcaaaatgataccaaccaactccccactgcccacggtatctggtgttattataatagcgttcataaacagtaaaacgtatattataaacagatagcccagccatttgggacatccaaaatggcggcgttaatctcacttttgatccggcttgagccatccatctttcacctgtttcatcaacggctgaagacccaatccagccgggtacacctgcaattgccatattatttcctcaagggcccgaaggccctatattattttgattcaagatattcaacacgagctttaagctctttaatagcattgactagcagagcaatagtacctgaagctgaaacgtttaaaacaccttctttttcaacgacagcttctggtaaaatttcctgaagactctgagctataataccagcttctacagactcatattcagttgaagtaggagagtttttcttctcataaatcaagccatcaagtttatcaactttatcaagagcattttctatttgtttgaaattacgttttaaagtaatatcagaacgaatataaacgttgttaaagttgccatcgccatcactgtagaatcctctgttaacataaacatcaccggcgcgtaattggagggtggtatttaaaatgtagttgtgaaacgacatgttattatctgaaccaccaaaacccatatatccagcattactaccagctctttgaagatatacataaatggatcggttcgcagcggtgttatttaacagtaaagctggtccgttaataccttgaacttgcaattgtttgtaaacagctgttgcacctgtggtccaacgctgtatgcgttgactgttcgcataagcattcagaataccatcgccttcttgaacaaatccagtatcagaatcgcctatagcaatagcagaagaaccaaaaccgctatctacaccaacacctaaaccagcagcagcttttaatttactattaaatgacgagctaccaccaactgtcaatgaatgactcattgttacgttgccacttgcgttatttatagccaacggacgaagaccattccaagtacccatagggtcaccggagttagtcaacataaaataagtattgccaccatcgtttctgataaagaacccgtagctaccatatgcaatacggaaaccatctgctgctttagaaactatagaaccgccgataccggaggccaaataatcatctgttacaacacggtcccaaggggtccaaggtgaagtagaatatttagaacgaagatacattcgactcgagttatacacacgatacgtctgttgaacaccagcgccagaagtaacagttaagtgacctgcttgtgcttcaggataatttaatgctaatgaagtattggcattagcatgctgagcatattcaccaagctggctatcaccagttagcgtatctaagtttacatttgcgccaagttggaacaaattctgataacgtgaatcgaagttaccaaaatcaccaggttgaacttgttttggaacggtaaaattaccatcttcgccaaatacatattcgccagaaccagcactagcgttaggtgctgtgcagttaacacgaataccaggacgacggtttgttgcactaggaccatctttataaagataaccatcaacggcagtagcaccagctgagttagtatattcccaacgaatatgacgataaacggtgtttttaaatgcaatatcacctaatgcatcaaaacgcgatgcagacatggtaccggaaatagtactattcccagaaacagttaagccgcctttattaattttaacaccttcatccatatcataagctgcataaccgcttccgcggaaataatgatgatatttgccgctagaattataacctaaaagtgttaatccattgccgcctgcgttgttattgtcaagagaagtatcaatctcaagaattgcgttkttattagctggtaaaattgtggtgttagcattatcggtatgagtaattcttgtagcttttctatgctcaatttggaacttagccacggaagagttataatgaacaagagctctagagttagccattacgctaaacattccgtctccgtcattgcggaaaccagtgtcgttatctcctaaagctaaagagccttcacccattccagaaatatatccaagagagtcacttccaggtcctatgaataagctaccggtaaattgcgcatgtccacgtacaccagctgagcgtatactaaacattttgtatacgctcagctggtgtacgtggacatgcgcaatttaccggtagcttattcataggacctggaagtgactctcttggatatatttctggaatgggtgaaggctctttcggcgcttcaggctcgttatccatctttttgatgggttcataatctaaatgttgagtcggtcgttgcgggttattttccggcgtcacgcgcattttccttttcgttgagctggatgttactgaattatagcttgtgactagtcgacgtaaccttttgtgagttcggtaagccactccataaacacatgcacccggcgggagaggttacggcggtggggataaatgagggagacgggcatcggttcagcccggtattgcg

SEQ ID NO: 6 - DNA, 174286 bp, Unknown
  bacteriophage genomic DNA
cggcggtggcggcggtggcggagctcgcgttggtaaaaacttggcttctggtggttcaggtggtcgtccatttggcccagccggtcttggtgaaggccgagattctaaaaacggtattgctggtacattagcggctcctggtcctcagccaccaaatactcgttatggctctcatggtggtgcgggcggtgatgttggacgcgccggtgctcccggtaacaaagttggtgaccaagcagaagggtatgtcggtggacaacctggtgcagcagtatatggaaatgccccaacttggattaaagttggtagcgtttatggctcaagagtttaaagcataaatacccttgaaaaggagggtatatgacccagagaacaccactaccaggaatatctgacattttatttggtgttctagacagactcttcaaagataacgcaaccgggagggtacttgcttcccgggttgttgcgcttgtagttgttttcattctttcacttacatggtatcgtttagattctattatgcaagtgtggaaagagtctcgttacgagacgtacactaaagtcctgcaacaagataaagaggctaaatttgaagcatcagctctagaacaactacagatagctcacgtttcgagcaatgcagatttttccgcaatttactcgtttagaccacgcaacttaaactactttgtagatttaattgcatatgaagggcgactgcctagcgcagtcaatgaaaaaaatttgggaggatttccagttgataagacttcaaacgaatattctgctcatttgagaggtgcatatttctcttctgaaaatgaatttgttttcttgccgactaagaaaaaggatggggagttgaagtacatgtactcatgcccgtatttcaacctggacaatgtatatgccgggacagtttccatgtactggtatagcaaaccactcttaaatgaagacaggcttgctgcaatttgtggacaagctgcaagaactttaggaagagccaagtaacaaggatgttacggcttgctatacatcatcatataacgatacactgattcaaaaccttcattaaactcttcaactagctgttgtttttcttcagctgtcatttcttcaatcattttacggaagttactctgattcagcggacgacctaaatcattcttaattccgatttcattcaaaaatgcaataaaatgttcacgtttttcaagaatgtgttcagaaccaaatttaatcaatacagaagccacagtaacaatttcgcgaacaatttcaattttagacatatcaagtatttcctacgacttaatggattgaggatatagtaacacagtcaacggtgaatgtaaacggtcagttcaccacttcccagcgttgaagtacatggccaggtaaagttacgtattcgtcaccagagtcatagcgaatggcgtagcgaccatcaatcaactcagctgatatataccattcggctcctactacacgaaccctacgtttcatccagtgacaaatctccatggcctcttgatagctgtaatctaccatgtcaccaagagcaagtttattaatcattccttcaagatagcgttgaatctctactgtctggttcattaaattttctcataattaatttgcaattcaaattcatcagcaacacctttgaggaattgataaccttgcatgacatcagaaacactacgtttagagcttacagtaaaataacaaaatgtttcttcacttgcttttatttcgcagtgagtgagcagagattccgggtgattaactgcgttaacaaatttttgaaatgttgtatcttcaaaatatttccaggagcaatcttgctcttctcggctcaaagagaaccatacaacgagatgatacacgggagttattgcatctacaatattagtatgttcatcccatgcttttcgttcggcttcagtatgagaaatattattcataatatccttccgtcatttcatcaatgatattgtcaatatgagcaatagcatcttcaattcgtttatcggaaattgctacgatttcaaatgtaccattcaaaaacatgcgaatgacaaaatcattgtcattaatatctgatttgacatcattttcaatttcacttagagtatcatagaaaatgccagtgccattaaattggtcctggaactcacgaagtctttcactggtataagtaacgtaaggtaccattttaatttcagatgttctcatagccctttcctttatgcttttgcttacgacgagattctttttcctggcgcttcatatctttatgagcgccgcctttgttgaaatcatgtttagctactggattgttcatcttgttcctcaagtttcttaatttggcgttcaagctctttaatcatttcaaggttaagcataacatagtattgcgcaaacaacggcttaatagttccgttccacatccatgggtcattgttaattgtcagctttttcacgacagcttctgataaccaagaccaaccggattcatttgtcaatgaagtccattgttcatgcatcatctcatttgcctttttaagagcactgatttgactacgcaaagattcaatttgaagcaacttaatattcattttcattaatataaatcctcggagaataatgtatcagcagggccacttttaacacggcgtgtattaatttgaccagcatgagttgcaatgattaatgcttctttacgagtaaaatagtttccccattggtctacaaacccctggtcatcaccataaacctgttcagaaaccactttatcacgcatttggtctaacaccagagccatatcttttgaataatgacgagtccctggaataactaactctccgccatctttcaatttaaaacgattagctgcacagacgataactcgttgaagtaaacgaccatcccaccaatcagctttaacgaaacagatttctggaatttccgccgaaggcgaataactttctagtttatcttttaaactttccggagattctttaaccagagcattatcaagtaatgccatacggtcttcaaaatttagttgttttggctcttcaatcattttcatagtgaaccctgttccgtcccaatcaagttccataggaatcatttgaaccaccctttaactttctgccacatagtttttggttcacgaattccccaaacacgaagttcaggttctttaacaacttcattaatccattcttcaacttcttccagctctttctttgcgataacgactgaacatgaatcaatgaaacgagctaatgattccatgtaagttgcacaatcaccacagtgacggcctaaagagctgtgaactgcatagcaacctttgtatttacgttcaatgctaccgagatgtgttccacggaaccagacttcccatgcatcggttggtagatggtattggtctgtcacctgttcagcacaacgctgaagttcatttaaaatcgctggacggttcattgactttttgacgcggtcgatttgagcattcaggtttttcatgttcatctttaatttccttattacagagtgtcaacagagtggatgatgttttcaatgttttcctgagtgcgtggaatgtccaggtatacattgccgtttttagaatgtttagcaaccattccaaggtcttcgaagtgtttaacttgttcttcagtcattttgtaaccggagatacggaagttacctttgtttgatacctcgaagctacgaataccgaaagtacgtttttcaagtaccgcgatgaagttgctacgatagacgtccagttttttgattgtgaacagattatctttggtagccagcagttccatcatcagatttttgtctgcttccatctggtcagtaatcggacgagctttacgagtattacgtttttcaagaagttctggtgcattttcttctgcgtagataactgctgcctggttgatgatttcttgaccttcagcagatacaatcagaccatcacctgatttttcaatcagacctttcttaatcagaacaccgatgttgctgttaactgaagcagctgaaagtttatctgcgagaatgtcacgaacttcggaagaagtgatgaagtctttcttagcgactacaatcagaacgtttgcagcattttcagagatagagttttcagaagctttaacgatatagattactttagacattttgtttctccaggttctgtatttgttttgatgagataatagtatcaaacttttaagccgatgtaaacggttagtttaacaccttccgaaaaagatgctatcaaacagcttaacctcggaagaagtctgcgaagagcttcttcgcttcgttcagagtttctgcaacgtcttcaacttctgcatcaagcactgctaccatgtcatagttgttgacgtacacccataacagcacgtagttttcgctttcgctgttataccaaattgtcagatagctattgctatcagtgtttgatgagtgaaggcgtgctgcatgcattgcgtcgtcaagatcaacacctgaattagccagtaaagcatttaagttattgattaaagtttccataatttcctcattttgaaacataagcttctaagacttcttcaaattcgccttcaagttcagggcatcctgcgaaatctgcctctaaagtttctaaatcaatcagaacttcagttaaaatgtattgactttcattatggtcataaaccatagcccaataacgtgcttgagtattcttgtcaattgacattctgttaaatttaacataagcgaaatcagaagtttccgcgataataccagcatttgttaaggcagcaacgataattgaaatcattttgtttactccgtttggttttgatagtgctataataccataagcaaacggtgatgtaaacggttgagttaaagaattttttaaagttaaccagaacggttgagggattgtgcgtagaaaggatgattaattatatggactcggctctagaattaactagagccgtttagagtgatacagaagctcttagagagcctccaggtccttcatatactcaatttctggagtagtttcttgccagtactttagctcagctttcaggtctttagcttgttgagcaagtttctttgcttcgtcacttgtgatgtgatagatgttcattgacactaacttgtcaacaaatggtgcataggttggacgagattcaagttcagaagtcagttgtttacgagttttgccttgaatgacaatactaccttcaataacttctttgatgaacatcgctttagccaaagccaatttgaatgcttcatcgcattctttgaccttgtgttcaattcgtttgacaatgtaagtcttacgaacttccacaaagtgcttgataagttcagaagaactttggaacttatcgtttaactttccgttttcatcaatgactacgatgaattgagacatcttctcaaccaatttgaagtcacgcatgattttctcatgccgctgctcatcgtcttggccaagcatataatctttcttgaacttcactttaaagccaaaaccggtctttgaacaatcatcaacgtaagagatgaagttcttatctaccattggttctagtactttttccacataagtttcgcggtcaaacttagctggaatctcactgatgtacatctgagatgctgacgtgaacttataaagaccacgacattcaattgacccatcttcaagacgaaccacttcaccgcggaattgtggaatttgaacttctggttctttatccagttttccttgaagagccaatttagtgcattcaactactgattcaaaactgtgtggaagaatcttagtagcataaccagttgcaattccctgtacaccattcagaagaacagttggaataattggaagatagaatgcaggcggaacgtgctctttatctttatgctcaggagcaatttcagtatctttgtagaccttacggaaattgtcagaaatacgacagaagatataacgagatgctgccgctttttgtaccaatcgtgaaccaaagttaccttgaccatccaaaagaggatagttgttgttccacgtgttagccatcagtgcgccagcatcctgtgctgaaccttcaccatggtgataaccgaggtctgcaacaccgccagctactgaagcaagtttatggaatttttctttattaccacgagacaaatctagtgcacgagcaataacaaatcgttgaaccggtttgaaaccatcaatcaagttaggaattgcgcggttttctactgtgtagattgcaaattctttggcttcattgtcaatgatgctttgaaggtttcttacattaagttgaccaacagagtcatcgagttgtttagacatcatgtcaaaaatagttgtcatattaccctaccagattaaattaccgatgttcatcataacacgagcaagaaaaagcactatttcgcccatcacataaactgctccggctaaagcgccggagagtaatattgacacaccaataacgcctattgagagtttcattttgttaaacctacgtaatagaacaaacgttctacagctaatgcagctacaccaaagcacatgcttccaatgactcttggcggaggggttaacccctcccaaataaacagaccagaagcgatgaaaagcggagccatgagcaagaacaccaaagcccaaatctgtttgaacggactcatattaatatgcctgaagaataaatttgaagttatcattcaacatgcgattcatttcttccaggttctgataagaatcgttatgtttacgtgtgaatgccagcgccaattgacctttaccaaaaccagtagtcaaaggcttcattttatcagccggaacgaagtacacatcgtagatgacgttatttgaacgcatagtacgaccaagctgagaacgaccttggcgaatctgcgacagaacattcataaagccagattttgaacgttgacgaccaacataaaatcgtgctgctactgcacgccaagctgaagcaccttttaccatgaagtagaagccaggttcagccagaacagatgggtcaacgtaacctacagtttcaccatttttaacagtacacacaacagttgcaccaacagcttcaaggtcaccacgagtcatataatcacgcatatcattttcctcaatcaattaaaagtttatcctcatagggcccgaaggccctgaattagtgcttaataatttcaataagcacttcatactcacttaaaccaagccaatatgccaaattaaatccaacataagctgtcgcaatagcaataataccatttaaccagaattttaagattttcataattcagtaccttgctgagccccgttccacagaacttctactacactcttgagcccatcagtttgtactgcttgaacaatctcaacagtagcccaaatgctaaaaccaattccagcagcaattagaacaactacaacagaaaagaaaatccagaaaatcttttccattttatccatacgagaaccaaaggtagtcttgcgacgcataatattttcctcaaaagttaatccatgccattaccacatcatgtgctaaggcgaacgcgaaagctccaaaaagaactaacaccaaagtcatcgtccaaatagctttaagaatctttttgatgatgttcattttgttctccgttagttgatttctagtctatagtataccattaaacggagaatgtaaacggcagagattaaaaaagatttagataccagccctgatagttgctcttacgaaccacggatttgaggtcttcgtggtctccagcaaactttagggtaaactggtaaacaccagacgaactttctactacatctaatatgataatacagtccgctactctgtgtgtcaagaagggtcctaggtttatccctgagccaccaggatagtctcctgagtaaccagtagtgactgaaatccactttgaatctgactgatgagtcttgacctcaatgcgaagtccgcagaatcttggatgagcaagaacatcccaggcgtatgtgtaagggtcgtcatgattttcctgaccacctgcaacataaccatccatccaatctgctacagttcgttcagcaagttgagcaatttcacaccgcttgtttacaaaatctttatcttggtctgggtcttgacgaagagaataagcggcagtacttttgattttgactctatcttctggtgttaaatcactgaatgaccgggtaaaagtcttcagggctttcagtctcatcaaccctggattcgattttttcatattcaccttcttcatttttgaaaatagcatctgtcacgtgtaaagtgccataatagattctgtcattatgattgagtttgcttaaatcaagctctttcaactcatcttctggcatgattactacatcatcacaatacagacaacccgatgctttattatctcctgcgaataggtctttacaataaacaacacctacataatgattaccatgtaagtaactatttttaatgcttttatcgccaatattcattggattaatcatggcagcttcctcaaaaataaagggcccgaaggcccttacattagatgtatgaatcagtttcttcgttgtattccgcttcacggattactttgtactgacaagtacgcattttagcgttgttgtaatctaccgggatagatactacatcgcgcggatgtactttaacaactaccagacgagaatcaccataacggaagtgtttgatatagctacgagcgcaaacatgcagaccagcttcgcaggtgagattttcatcttcaaccacatgagtacgaggcattttaactactcggccaacagagttatcaaacttaccggtatagcagtcagtgtaatcgttgcgaataactttccatgccaggaaatgaccatcttcagtgatttcgatgtcgttggcttggaggaagtcaaacagacgagtcactgcagttttgcttgggttttccagcagattttccaggaacggcagatagaattcaaaatcttcaccattctgcatatcattgataatgcggtcaaccagaccagatttgatttcaatgtcctggtagaacagctggccattttcaatgcgaatgttaccatcaacataagaagtaattgccttctcaatgttaatcagattaattgcttcttcaaattcgccatcaacgcacagctgaagagcttctttgaagtttggatgatctttatctgctgcataagtatcacgaccataagtgatagacaggaacttagaagaaccggcccatactacatcatctggattgaatactttaattggtgaagttacttcaacttcaacttctgctttacggcttttgatttcattaacaacacgacgaatagtatcaacagaacaagagtaaatttctgctaattcagtttgagtataaccctgcatgaattcatcatgaatggctactttttcttcgtcattgaacattttaacaacagagactttcttacgcatcttcactttcaccttttaaggaaggagcgccttccagcgctctcataatacgggagatatcatcggcataattagctacacgccattcatttagcatatgttcgatgacaggatattcttcttcaaaccttttaaatgcagcttcagcttcagctgtagcagcatctgtgagtttattgtaaatcagattacataaagctaaatcttctcgaatttgagttggaccatcttgagccgatgcaatcgtagtatttctcaagtttcttccaatttcattaatgcgagatactttagttccgttatctttaccagtgatgaacttcaacagccatttcaatttaggcgtattgatgatattgcttacaacacgacgattgaagaaggacattggaagatactcatctgggtccatatcatcaataatcttgatgtactcatctacgatgaatctatccaaagattcaagattatcattgagtttcgcggccttagctgaatttggacgaattacatagaactctgtaatgccaaattctttcgccatatttcgaatagtttcaatatctacgccagaccaccacagttcgtcagggaaagtacgaatctcatcgcgtgaacggaaaattgcataaccttcaagttccgcaatatcgtccttgttcatgaataagtcttcagaagtccaccaaccacctttagcatctaacttatgcaattggccgttcggagattttggacgtggtccaccatcacctttagatgagtttgagtaatgctctttttcaaacttacggtattcttccatctcagaagacttcagaacaacaacttcatcttggtcaaacagtttgataatttcatctttaatttcaagatgtttagggtcttcagggtcaatcatgataaaacgctgatatcggtggaagtctttcaaatacattccacggaacatcgccgcacgccgagaaggcttgtcgtcaatcatgatatgaactttattctgctgaacattgagcagatttgaaactgatgtacgctttctcgttgaccaagaactcgtaagacgcatacgctcagcatccaggttcacaagataagtgtaaaccattgaagactcaattttcttctgaagttcattgatactataagtttcaacccattcgccataagtcttatcaccaaacatgatgttctggcgattcagaatagcacgttggtttgaatcaaattgagacagctgacgaactagctcacgcttattctcaatagactgaagatgtgcaatatcagcttcaagagtagctttttctaagctattcactcgtttcttgatgttttcaatagtaacatcgtctaatgaaagctcttcacgagatggagtgatatcaagttcaccaagagggaaattgatgtaaacgcatccataacgatttaaaagccaagaacactcaagaccatcaaatttgtcgataggataaacaattttgccataaactgcatacagacccttagcatctttaccaaatccgttgggggaatggaaccattctacatcttgtgggaaagagtcaatatgaatgtttgcgccagtaataattggtttaactggcatcggacgcattacataagcaatttcatgcgcaaatttttctacatcttcaagacgaacaggaaccgtaatttcaataccagtctgctcaccttctttcattggctcaacaaacagaggacgaatatcaggttcgccattgttcatcacagccatgtatccgcgagcttcaccttcgtaataagaaacgatagtgaatgacttggtgtagctgaatggagattttgaacccagacctaatgcaccgataaaatcgttgctttcagcttttgtcgaagcaaagtagctattgtacagaccaggttcttcgtcattaccacgaatctggaaatcactcataccaggaccgaagtcacgaataatgaatcgtgggtctaacttattcggacacttgatttcacacggaacatcttgctttccattcagaatgtgagcatcaagccagttagttgtaagctcacgaacaacagcacggattttattcttatagagcttatcagacaaaatcataaaggccttgggagaggcctgaatggtgaatttagttttcttaccagcagaacctaaaacttcttcattatcagcaattaatttcatatctctcagtcacagtgtcgttttattaggttagctacatccagaagttcttccgcagtagccgtatcggtgataaaaattttattacgaatttctttaaagcgctctttgaattcttcagcttctccaatgtcaaagaagcgttgaatgatacgatactctttgtagatagcatcgtcgaacagttcagcagaaggttttaaagttaacatttgatagttcctattgagttaaggattttcgccatttgttttattgtatacttttctcggcgattgtaaaccaccttcaacgcgaacgtccgaaggttcataggaatggtctggcgagtttcaatacagttaacaatataatctattgcctgtttgaatttaatgtgataggggtcatctggtgaacctccatgctcaactagatgtcgttctccattttgtttgatacattctgctacattttcaagatttactaaagtgccatcttctagaatcatctgctcacctcataaaaatgggactcccgaaggagtccctaatcattaccacgaagcacgagaaacaatgcctgtgactttagtataagagccgttggtatgtcttacacggatagtgacagtatcacctgggagcggcagagcatctccccacatgtagccgtaacttccatctactaatgttacccaaatctgtgacataatagctccttattgtatcgggcaagacgcccgatatatttattcgctcatccacactttacgtggagcagcgtcatcacccataaccatttcgaagagttctttccagttttccggaagagaaactacatcataatgaggatgctgaattactcgttcatattcgtcttcttccaaagaaccgagccctttgatataacgaagtttccaaccaacgagttcattcttttcggcttcatattcagctgcagtgtaataccatttctgcttatctcctttactcataatgataacaggagttttgacgaagcgaattcgaccttcttcaaacagacgaggccaattactaaagaatgctagaagacttggatagattgaacctgttccgtcgacatccgcatcagtcatgatagcaatgtttttgtagttcagactttcataatcttcaccgatagtcaatccagtgattgcacagatgtcgaagacttctttattcttcattgcttctgctgcagtcattccccaagtgttcaggaacttaccacgaagcggataaccaccatgtaatttacggtcacgagtagtcagaagataaccaattgcagaatcgccttctgttaaaaacagagtggtttcttctttatcattgccataaagctctggtttaatgtgtttagcaaccttagcctttgaagcagcttttgcagctttagtttcagcagctttttctgccgccaatttacgagccaacatagcttcaataattggcatatgaattgcttcggacttcataacttgttgagcaagttttttgtagtccaaattcaaatgagctttaacttcaccccatggagatgtcagacgttctttagtctgagaatcaaatcgcatattgctcatatcacgaacgaacatcacgaaagtaaaacactctttgatacgagctttgtttacttccaatttgtacttgcgtttgagcattgggattagttcatttgacaattcatcaacaaccaaatcaacgtgagaaccacccttagaagtatggatgttgttcacataagtaagttggcggaaaccatcatctgaacgaccaattgcaattgagcaattatcttcatcagctacaatagcttcttcatcaaattgtttagcgaattttttgaatccaccattgactttcttgccttggaatttgaattcaatatccgggaatactactgccagagtttgaagacggtcaagaacaattgattcatctacttctgtaagtcctgaactttcgaagtgactgaagtcaggaatgaacgatactcgagttccggtcttggtttgaatgaactctttttcctttgctggcttactatcccaagagatattctcagccccattagagcatcgaacgatgatttcgttttgtccgtcacaagtagctcctgcaaaagttacagagaaaatattagtcagtgcagaaccgacaccattcataccaccagttttgcgttcagcatcatcaccaaagttaccaccggcacgtggacgagtccaagcagctactggtccaggaatttcatcaccttctggagtgactactggagcttgtggaagaccacgaccattatctgttacgataactttattgcctttaagctcaactgaaattttatttgcaaacttgaagttggtacgaattgcttcatcgactgagttatcaatgatttcgtcaatcagcttgattacgcccggaacataagttacactttggaatttaccaaacagaaaacgttcatgagcttccatagctgaagagccgatgtacataccagagcgcttaatgatatgctctcggtctgacagaattttaatttcgttcttaatcatcatttgtcctcgtttaggtgaacattctaacattcaaatcttaaagcattacatccgagagattttttcttcaagttctgctttgtattgtaacaaatgagttttagcttcttcaccataaattgcatcataggttgggttatacatgctatacagtcccttttcacgacgctttttatagaacttatggcgcacttcacgaaaattcgtatatgcgtatatatcaacaccataatacgcttcgcactcatagcttccatcttcgttttgatgaacatgctcatgacgaatctcataatacttttcaagccaaatatagcttccatcgactatacgggtaggccataaagcaaacttcctgcgcccaagcgcattgttcacaatttttagttgcttgagcaaatttttatgctctacagttaaaccgaatctcatactgttctcctctttgtagagctattttatcatactttgtagagaaagtaaacaacaaagggcccgaaggcccttttattatactttgtcttgcagaacattagtgaattgtgaaccacgccagaagtaaccttggtcattcggatgaacgttatcgcttgaggtatacagatttgcgttctctgcagtaacccaacctttaacatctacgaactctaagtctaactcagtagtaagttcaatcagtgcgtcacgaaccgctgcgatttggtcagtcattccaagaggagttgctggtccaaatacgataattttagcttgtggctgatattgcttaatcagagcaatagactctctgaagttagttttaagcaaatcaattctaccagccggagcgtcattatagcctaaagctaaagtaattatatccggagtgaaactcagagttgcaagcttagctgtgatacgagcttgaggctgagttgagtttgttgaagtccaaccagaaccaccgatgccatcagctaatccaactaaaccaagcttatcacaatagaaacggaagtcgttaaacgacgcctgagttgccattgtaccgaaggtgtaagagtcaccaagctgccaaatcatcttagccggacgagtaatcgcagtgatagtttttccagtatcaacataaattccaccaaaggcagtattcacgccaaccagagaatattcacgcatttgctcaacaccgttccaatcgatgctatagatgtaaactgcaccagacgaatcagtggtaactgaagtggcagagatgcgctgtccatctacataaaggtcatacttggagttattcccggcgagtttgaaatcaatcttgcttgaatcagttttgaaattaactcggcattgagttccgttgccagtaccatttcctctgaagcctgcaaccgcgtctttgatatcagaaccccaataagttattttggaatctgtgcgagcaattgttacaccagcataaattgttgaagctacgcctgcgttagttgttactgcgaatttagcacctgtaccagttccgcctgttgctgaaatttcaccggtaggagcagttgcgtacacaccaggtttgcgaatttgagctgttgtaatttcaccattactaccaacagcagttactcgaatctgtccaggaacatctccttccgcaccagggatatcaacaatgtcaccaaatacatatccagtaccaccagaaactatcgtagcagttccagataatccaacgcctttaagcaatttttgagtaggcggatttgacatcacatcaacaggttgaagcattggtcccagcggtggctgagggtctggaccatctacagtatattcgcttaatgtgtattgatagccatttttagattcaatgaaattaacttcaccgtaatctacataagcttgtttgagagtatcaatttgaagtgcatattgagggtcagcgtattcacgccagtctttaccttcttccttggctttaataaggatgttatgaatccaccaaggaaggtaaagaaaacttgtattacgccacggaataggatgtaccgtggtccaaatatctatagccataatgttctccttatagtctatagatatttattttattcaaacctgatagtagagttcttaaagaacataccagagcaaacagcacccttgacaggaatacctgtaggacctttagcagtgaaacctgtagagaaagcatctttatcacaactcagccatgcgtaacctgtgaattcaatttcgctaaatccattagctttaagaatacgctctgcgcctgtttcatctgtgcaactagacagaataccaatagatagaatagctgcaatcaaacccattacaaacactttcatttcttggttaccttaataattttgccgctatgaagtttaataacccggctttcgccggatttcatgaatttaatgcgtggacgcatacccattaataatcaccacttttaagaccatcataatgaaccgccggagcagaaactactcgtttcatttcgccttcacagttcaagaatttgcatggctgtggattatcgcgctcagaaattttaacattcttttctgatttttcaccgcaagcttcacactgataatcatacaatggcattgacagcctccgaccactttttagttttaagacgaagttgacgatttaactcttcagtaactgcaagagcaacttcttcatgagaagctccgtccattttatcacgcatatgcaaccaaagagcatcgattacgcaattaattacatcagcgcattcgccagcaaagatttctttctgacgatgaggacgattaatccaatcacacatttcaccagtttcagaagaaagctgtaacattacggatgtgatgttgcgccatggtttacgttcggtataattagccgaaacacgaagtactggagtgatatctaatacttgcattatttcttccatttcatagtttgaagaatttcaatagctttcttgcgttcagcttcgctttcgattttgaacaccatcacgccttcaacttctgcattccactcttcagcttcagaaatattttcaatctcatcatcaagagtcatttcttcatcttcgaaaaagtgttcgttaataaatccaggatgaaccacgtcaaagtatttaagttcagatttaactaaagcgaaattgagtacttgaagagttccaagtctatcagtgaatgaaattttcttagtgcgagaataaccgcaatcgtaatcaacagcttctactttaaaaggattagttcctacacttaaagcccagcgcttattgattgggctaagagcaataaaagaactcaagtctttacaacgatatactgttcctggaacccattccgaatttttttcaacgacatcgaaataatcagattctttagcgtaaagataaaagaagctgggtgaacgagtgccatcagccattacaacttcgcagacgtctttttcatccatagccgcaactgtaaaagtgccgccatggatttcaataaaatgacaaatatcttcgttttgtggctctaaatggacaaatgctgcaacaagatttgggttcaaccgataagttaaaccaagtttgtattctgaagccattaataagtttccttccagtaatctgtgccatcttcagagatatgacggaaaataccatacagaggcatttcgtcttttacatcaccaaagacataaacgatttgagtatggctcaaatgatcagtgtgttctttctgtacgacaaccaagtctggattatacagagtatcttcaaattcgtcacggtttgaagcagtagtgataggttggtttttcatgattttctcctcatttgttttgatagggctatagtatcatagccctctggaaaagtaaacggtttatgcacggcctggacggttgccataactcatcacgtaactaatatcatctactggaactacagcatactcacccatgaacacaacgttggctacgatttggtcagtatcttcatcacgataaaccagagatacccaagcacccatgccgttgatggttttaccactggaattttcaagtgcgttatgcaaatctacagaaactggtttgccttcgaacttagactttgctttaacaagcgcagtatcaataggttcattaacttcaacgaaacgatacttagcagaaatcttaaaaccacttgaaccaagagtaggacctgcaacattaatgatgtactgaccgcgagctgcattgtcagagataatccaaccaaccaggcctttgttctgaccaccaataacttttacacttttaccaatcattttactagccatcttatcacctttcatttaagagaattcaattctaacacattaagttaaagcagattaaccgcggccttttggtaaagacagagggtcaatttcatcaccttctggagcatcttctaaaccaagagcataacgttgggcgtattttaacatcaaaatatctttagcacaatcgtgaatagagtcatgtgcaatgaaaccatccaggacacccttacgaagaggagttgtcgtcaagtcacgagttaaaagcagagattcaatcgctgtacgaatatctcgttgattccagaacttacaaggctctaagccgaaagtatcgatgtctttttcagcaatacctttacgagcttcgccttcacggagaatatccacaagaattgggaagtcgaaagattgaccacgacaccaaccgaaagatttccatgggtcaacaccattgtctttcaggaattgaagcagcttgtacagaccttcaacatggtcaatatcttcatcagatggaagcaggtttttacgagcttcttcagactgggatttccaccacttcatagtagaagcaccgaacagacgaacaccttgttgtgctttaaggttgaacttcagtttcataccgcgctgaacgagttcatcaaacgtttcaactacttccgggttcgggtcaaatacaacagcagccacatcaataacagcagaacgagagacgttaccgaacgtctcccagtcaataataaagtctttaatcatgtcatttccttaaattcacgtagattaccagcaacaaattcagataaagtaatctttggatagtagccagtataccacgaaatagctttagcatctcggataatgtcatttagttccaacacaatctggctgcctttcatattgattccgcgctcagttgtagtagatggatttgacaccatgttatctttgacgccggctacaatagcctctgcgtcttcaacggtaattgtgtacataagcctcacacataataaacatttttacgagcacgagttgtgccaacataaagcagctgttgagctaattcagcatcagccatatgaatacacggagtgtaaacatagcagttatcaacagaaacaccctgtgctttgtggaaggttgagcatggaagtgctttcaccttatgataacgacgtttagcagcccagaaatctttccaaggtgctttacaacctttgttccagttcttgtaagtatcagctgctttagccaagaagaactggaatttgttctgttcctgctcatcagcaattactctgatagtctctctgtagtaatcgtcttcatcgccgtaagtttcaagttctaaatcccaatgacgaaccatgtactcgcctggaactcctttcgccccaatgaaatctgaggactctttacatgaaagaatacgaacatattggccgttgttgaagatgacctcagagaacttcttaccgtcatattctaactctttgatgagtggttcctgcatcactactacttcaccaacaataaatggatcttccgtctggaaaatccgtcgacgaataatagagttcaatttatcaacggatttgttggtgaatgctaacattcgattctcaaacatatcttccatggttttgacattttcaaagtatgtcatcatgaaatcgcgtaaagcggtttgagaagtaaaggcatgaacaccttcgccatctacgagatgctcataaatccactcaccattacgaatgtcagtagcaacttttatgattggagcattacttcgcattacctcagtaagataaagctgctcaaaatctttgtgggtgaagaacggagatagagccggaacagtgcttcctggttctactggacgaatctgagatttatcaccgatagcgataatcagacaccaacttggaacactggccataataatttggaaaagcttacggtcatacattgaagcttcatcacaaattagaactcggcatttagccatgtccggaacttcactttgttcgaagagcatgttctcttcgtaagtggtcgggttaatcttcagaatgctgtgaatagtgttagcagccatacctgcaagcttactaagtactcgtttagctccgtgagtaggagcagccagcattacacccgatactccggttgaaatcaaataattgatgatgaactttgtcatcgtggtcttacctgtaccggcaggaccattaatagtgatgtgactaccacgaccagctttaatacgttcaactacacgattgaacgtagccttctggccttcgttgagcatatcaaatgtaatattcaaaacttctcctacgcgactttaacctttttaacctgtaatgtgttaatcatttgttgcacatgtcggcgctcttgttcagtgagcggtatatgttcaataatatcacgtttgaagaaaagccattttgttacttgagtctctacttggcgaccattttccaacagatgctggagttttccaagctgagtccccatatatttctcagctgaaattttatttgtaaagataaagcaaagaccaacaggatttccatcccatgcttcgtagaatggaatctcaaatccatctttatcttttgtaatcagcgcgtagccatagtgcatcacattttacctcgaataagttgaaacattgaagcagataatgggagacctttattcagcttagctttatctataaaagataagttctggaagcgagttaatcccttaattactatatcataattatggacagaattttctgcttttgtagcccttttacttgtggttgcagcttttgaagccagcttgtcagtgttcccagaaactttacgaagacgcttaagttcagctttacccccagtgatacgagcctgtaaagactttttcacttccgccgtgacacctttttgcttcatatgctgttcacgtttagcgatattgttaagaatagccaagtactgtttgtgatactttttggcgattcccgccagcggatcgtcagattctggttcttgttggtcgacaatgacgtgaccgcccgcatctgcagcacgaacaatacgagaagctaactcatctcttttctcaataagctcctctaaggagaagtttccacgagcagagttgtacttcttcttaaccggaatgacattacccggcacatatcctttgtcgttgtcaaaacgctcaagagtcatcatgtcatcgttgacaccttcacagaatggctcacctgagtaagcgcacactttctgttgagcgatgttagcaagatatgccatagtcaatccaaaatctttttggcggcgtgtagctgaagcgtaagtatttactaaacgagttgcaacgacaatttccaatggcttggccatatgatatccttatatgcttttgcgaaagtagcggtataatggtttcaaggagtattctataacatctgattccggttgtaaacggtcagaatgaaataagttctacatcatagattgtatgcattccacctggattgaaatccacatcctcaatgctagttactcggaacttcgttccgattggcatcatccattcctgttcatcctggaccatgttaattttattcttacggtcaatttttgctaaagggtcgtaaggtgctgcgctgaactcacaatttggagctgcggctaaaatctttagcatatcttcctgatagttataagctatcgtagggttagaccagcgaatgatggtcttggtcccatagcatccaaagctagcaaaacttcttgctgtgttaaagtcggttgaaaagcttacaactctttcagatgtaaaaacctctccaacttcgacgttttgaagaacattgagcattcgtctgttgacaccgcgataaagcacttcaggggtagcagttgtcatacgacggcggataactttatccaacccacgattaacccagtcttccactttatcgttcaaacacttccatagaactgcttgttcttcatcagtgaacatcgagttaacttcagactcgagcattttacgctcaacttcctctgagccttcccaatactcatagattccaccagaaggaactggtattgatggtgtgatttctacttcaatgacaggactttgaaatgatgccatgataacctccgtttgttttacggaagctatcataacacagaagagaagggatgtaaacggttattttgcccagggagcccaaggcggagggtctgcccacagtgaggacagttcttcacataaaggttttgtgtaatctaccccatgctttttgaagattagttctagctcagtagcgatactctggtccacctttggaccagatttcatatcaacctcgacatatccttcaggaatgtcttcttcaaacatatcgaaaatgttactcaacgcggaagtgcctccgttttaggaacacccaatagatgccaaatacctctacgaaaaagaatcatatcaaactggtctgtgattaaccaattgttaaaattcatagttccgtattcatcagtatgcatcatatttggaattttcacagtatcgacacttttaacaccgaatttgggttctggaataatgtcaataagattagtttgtggaattttccaaccaccaagcaagaaactgtcttgagtgtcaaatggagagtttttggttttaacataagtgttgtattctttgatgataacatcaacaccttcaggccaaccatttttcaattcacttgggtcaacattatcacgacaaccagttccatattctaaaaatggattatagcagatagctaccatgatttctcttctgtagagaggatgtcttttgtcagtgaacgatggaaaatctcgagaaacaaattccagaccgaatgtagtaattttgtactgtttttcgtcagtcacaggtgaagcctccgccagtgtcacaggatgtatttgagggactatcaatatatgatgttgtatgtatcattggactatcagaataagatgctctggatgaactagagtgattctgatgattaactggagtatgagttacgcgtccagtataaatctgtccatttcgttgaactttctctttctttactatcacttcttccatcattccgtcgcccatgtaaatccattcacgttgttcatttgcgccttcctcatatgcaacggccatatcattagctccgtacatatgttgattgatgctttcatcaagtcgagcttcttcagctttgatttgggtatctggccgaggattaccgaataaccctctcataaaattcataatcatcaataactccagttcaaaaattgaatgttgaatacatttcttttgtaaacgccatcaactttaactaaatcataatacagaacttcaatagcacattcaagagatgttccaacttctctgtatgcatgtagcttaacatcgacaaagaaatcagtgttagtttctctttctatatactttaagcgaactaaatcgctgattccaccacaatcacctactggtttacgccatggagttgttttaacattcataatattttcctcatttagtgaagtcattatacactactctataaaagcaaaaaaagggactcccgaaggagtccctaaacttattattcagaaggcgtaacgtcaaacagagtttcgttagcagcaatccactcgtcacgctgatttcgttcaaacaccgtagaatacgctggtgtttcagatgggaaaacctggtagtgagcattagcgatacgatgaacgtcagaatacagttcaaatgctacagaaatttctttaccttttacttcgccagcagaagtctgatgatcgaaagtttttacgtttacataaccggccattgtaatctcctttaattagttacaagtttatttattcaataatactggcaacttgtaactcaaagtttttagttctgatagtttcaatagctgaatttatttcttctgtatttccgctaccagcaatatcagaaaaactttcatgaagactaacaagttcttcgcttcgttccatgaactcttgttgagttatttcaagtttaaagaactctttaggaacttcaaaggtgtattgacctttggctgcgataacccattttccaaaactggattttatagctacatagtcttcaggagtgttaaacttccaatgagctctgtcagcgtaagccgtgctatgctcagctggagaagctggtctcccagctttctgccacgcgtaataatcaaatttcattaataacctcggtcttgtcgagcaaagttctctgcgtttttcagataatagagtttgaacacttcttctgctgtcatgccaagagccatgattttattcaggaagaagtgcagctggtcaatcagttcaaatttgatttcaagctggtcttctggtgataagtctttaattttcttagactgcatttctacatgttgagctttccaaggcttccacacagcagatgctgctttttcaccgttgctcataccaccgagtgcagtgtacaattcacgagtttcatctgcgatgtagtcgtcttgagcacgcaaccaagctaatacttcacctgcagtttccagagaatcgggatgacggttactgaatggtttatcttcagcaagacgaacttgaagagatttctgcatatcgagcattacttgcagagggtcttgatgattatcaattactgcattatacgcaccgtttgcttggtccgcgccttcaattagatgtgagcattcattaaagtgagccattgtgttttccttttgtcaaatcagaaataaattatatcattaactttatttagcaacgaatccaaggttttcagacattttgcggaatttttccatcttttcaaatttcttccaaacttcttctctgtcttctacgaaatcaaaatcagtatgcactcgcaaattcagaagacaccccataatgtcgtttaattcagctattaatctttcacgattagttttgccttcatattctgagtcaattccaaactgaataatcttagagcaaagcattgctacttcagtacattcttcacctaacttaagaaaggcatgttgttctatgttcatattttagcataccgagtaaatctcatcttagccattaagcctgattcgatattgttgttgatgtaatccatgatttgttcaggtgtagcaccctctttcataatcatgtcattcacgtcttttgaagaccaaggtgacttatcccaaaagacaactctttctccagcatcaataagcttcttcatgcgcttgactgtatctggatgacgtggttcatggtccataatccaagcacgattaccttcatacggaaccatgctcaactcaatagaaccaccagtaattgcgatagcattgttgatgaacaaactatctaatggtccttccataacaaacacgagcttattagggtcaacggtatcttgaccataaattttcgtagcaagctcatgagctttaattgtcatgtatttttggggagcgtcttttgagagggctcgcccttggaaggattcaattttgcctttttcattaaagattggaataaccaagcgcggttcatttttctcatgtgagtatgtaccttcgtttactgagttaacgagagccggccattgagtagtaaaccacagtcggttccatttatctttaggaattttacgtccagcgatgtatttgcatattggatgagccggtgaaagcctatctaatcgctcacaataatcaagcttttgaatgaacttcttttcaaccggaggaagtttaacttctttcttaggagctgagcgagcttgaccttgttctttacgaacttcaagaatgtactctcgatataagtcaggttcattttctcgcagatatttagctaatcctaagtgtgcatcacagttatagcaatggactacaattccgccagttggttgttcatatgcccatccacgagctttgaattggtctttttgtgagtcaccgcaaattggacagcggaaattcagtttaaaacgatgaccgtttgttacttgtttgaatcttggaaggtgtgaaaatgcgcggtatgcaaattcattgtcgacccatgacatattattctccaaaagaattggccttatttctaaggccattatatcacagtttattgagatttactttgatgcgcttacgtttctttggtagggtctcaggacctttattggtgattgctccggttgtggtaccagaggcgatattctggacacttccaccggaatctccggctaccatgtcctcgaacaagggaagagcctcaaatatctctttttgttcggattcagtgatattgtaacgtgaagctactgcagaccatgcactcatcatggatgctactccattgagtcctggaacagttgttaacattcttttgattgaacgaaccgatgcgtggaaagctgtataagccgctttctcttctggagtagtaggtcgcttcagaaccgtacccttttcatcgattatcttggcttcatatgctttccattcagtaaatggtttttgcattagccggataaacttatacgcatagacggcatcaatactgcttttaatagttgacatagtctcctcttctatttatcgtttaacacaaacgaatttagcagaggttgaaaaatcacgagcagaagtgcgccactcttcaccagcttggttacacagttcttcggcagttgggccggtttgtgttggcttgaattcaatttgattcatagcaactccgccgtgttcactaataagagtcatgattaaaatgaatgtgtgcatcgtctttcctgctctgttttaattgcgaccaatattaaacctttacggtaagattcacgagggtctgccggaaatccccaacgagtaagtccagtttcaatttcacgttcaaaacgtaaacgaagctgagccaattcagcgtcatgataatctacaaggtctctgccttcaaaaatcataagccaatccactctaaaacttctggaacagaagcattttcacaatacagatttgtgccagctactaccaggtcactttcacccagatcttcgataagcatcttttggttcttatctgcaccagcttcaaggtcatgaatcagcttaggcttaactttgtcccagtcaccttcaacaaacttgatacatggaattgaagtgtaatctgctttagccatagctggaacagcagagcaggatgatacagcaaagattaatgcaagtacaagttttttcattttattttcctcaaatagagccacatgccttatgcgcatacaaaattgctagcgcgaaccagacgaaaatcacctgctgcgtagatacccatcgttacatggtcgctagtatctaagtaagggggtacaataactttaaccaatccaccgttgtctagaatttcacgaattacaccatcacaacgtaaatttgcgtcttcagccttgcgaactatagaaccaactttaaacggtgttgtcaggatatttgctttgtgagtgcgcgcggtttcatcgataagtttttcaattgtccagattgccatgatgttttcctcttgtttagtatgaggtaatagtaacacacttccatgtgcgtgtaaacggttagaatttgaggtcttcagccaatgcatcgagtttagctcttgcactagcgttttgttcaacacgagtcattcggttaccttctgcaactcgttgctgagcaccggaagtctctttgactgaagtcggttgttcaccatgttcttgagctatttctacccagcgctggttgcctttacttacaccaatcaagaacttattgttgatgttcttatcgccataacgagacttaatctgcttgatgagctgttgaccttgttgagcaagttcctcagtttcaattaccgctaacataaagtctgctgttgctggtagacccgcggattctgcaacatcactcattgaaacgtcagaagcatcccaacctgaacgagttgtctgagctgctgtccacaaaacagtttcagattcaacagccaatgcacgaagttcttctgcaatagctttaactaatgtgtagctgttttcggtataaactttaatacggcaagaagcacagatacccagatagtcaataatgatgacatcaggaacgaaattcttcttcagtttaagttcattcaataacgcacggaacgtatttgcatgagccccacctgttggatactgcttgataatcagacgaccaagagtattctttgagcgccatttttccatcttacctttgtattcagcatatgaaatatgaccatcatcaatatcgtccaacgatacatcaagtaagttagcatcaatacgttttgcgcaaacttcttctgccatttccatggagatatacagaacgttcttacccatctgaagatagtcagcagcaagagaacacagacctaatgacttaccaacgtttacaccggcgagtaatacgttcaaagtaccagtctctgcaccgccttttgtgattcggttcagaatattgagtttgaatgcaaccttacgagctttattctgataagctaaccaacgagcttcatggtcttccatccaatcatgaccaatgtaactatcaaatgaaattgacagagcagctcgcatgatgtccggaattgcacctacatcaggaagttttttgtttcgtttttctggtggaagttgggcgttagtctgaatttcaataatctttgatgttgcattgtacatcgcagattcttgaacaaaacgttcagtttcagctacgagccagtttaaatcttctggagtatcttgaagcttattaattaactcacttgcgccctgtacttcagtttcaactaactgactattatccaaagccactgccaatgcagttttacttggaacagcttgatatttaagaacgtgctgatgaatcagtttgaaaacatttttggctgggccatgctcaaaatactcatctcccatataaggccaaaccttcgcgaagaaggcctgattatacagcaaatgagataagattgtttctaccacgataacctcattaaaatagtttgaaacgttttttctttctcataatttcggcgtgagcctgttgaatttgtattttaatacatttttcaacatgcggtgcaaggtcggcttttcgtgattcgtccaacgtagagaactctagtgacacctggccgctttcgtccaagtgtaatgaggtaacatatacgatatgttcctcgccatcctctagggttatcaggatttcctgaacgacattctccatagccttttggactatttctagactctttttaaacatccgctcagttctttcaaattccccctcctgagagggggtttcgtcctgaacttcaacttcagtcaaatcgaggtctaagtcctcgaaattattcttcatcgtaattttccagttcatcttcgattgaagctggagttgctcttacttcgccttccggagcgtggaacacttcggtcttcgaattaatcagagcatcaacttcttcatctactactgcattggtttcaatagcacccaactgatagcgatttttaatagcatcgcggaatggctgatgtttaaacagagggccccagaatgcggtgcttgaagtatcttttgcacgccatgatttctcttcgcgaaccatttcaccggtatctacgtccagatattcacgagcataccaaccgtttttaggtttaactacaaaaccaagttccagcgccatatccaacagaccagagtatgggtcaataccgccatcgaatttaacatcaatgaagaacttactcttctctttaacagtacgagatttctcagcattcagaacaaactgataaccttgaaggtctgtaccatctttaatttgacgtttaccaatgatgaacacagtatctgctgaatacattgggccagtaccaccagtcattacagtcttactgaacatctcaattgtttcgattgtgtggttaaccgcaacgcatggaatgtttttgatagagaagtaaggtgtaacaatacggaacagagacttcagtgatttcgcacgagtcatatccgcaactgatttttcgttcagagcatcttctgtttctttcttagaagcaaggttaccgatggagtcgatgaatacgataactttctcaccgcgttcaatttcttccagctggttgaccatgtcaatcttaagctgctcaacagattgtacaggagtgtgtactacacggtccgggtcaacacccattgcacgaagatatgctggagtgataccgaattctgagtcgtagaacagacaaatagcatccggatattttgtcatataagcggaaaccatagtcagactcatatttgacttgaagtgctttgacgggcccgcaaagattgttaaacctgattgcatgccaccatctaatgcacctgaaatcgcgatattaagcatcggaatcttagtacgaactacatccttttcattgaagaatttggatttatccagagatgcggtcattttagaagtggatgctttaatcagacgagattttaaatcagacattaattattttccataagtctccataatatttttctcacaggtttaagatagagtaattatatcaactgcggtttaaagcggattgcaatgcggtgaatcattttgacaaggtgtgtaacaacaagcattacaatgaccaccgacagagtcggtggtgtattctttagatttcaattgctttcttgaattcagcttgccaaattggtttttcatcaagatatttttgaagaattttatgctgatattcgagagtttcaattctaaagtcctcgtcgtttttgattttattaattttgtcaacaagctcttgacgattgctcacatagaagaactcattgccttccatgatattcatgtcagggtcaaatgtgctatcgaagaatgccactgcagtagatgccagagcttcccatacacgaggagtgatttggttattatcgtaagtcttatcaccgagtacgatagtagcatacgcggttgagttacgttgaaccatttcacgagaatctaccttcccaggaaatactggaggagtagtccaagggaattctggattcttgaattggtctgcctttactgaaccaaagaactcaacatccaggccagtgtcaaacagatattcaaccatcttagcttcacgattacctgaacggaatgttccaccataaatcaggtcacgcattttgatgccatcagcagcaatcttgaagacgctgtgatacatcttatgacggtccaatgcgaagtgtacaaattccattctgtccttagagacaccaactaaacggtcagagtgaattcgtttagcttgttcaaggtcacgaccctgagaaactacacgaattggagagcgaacaatgaactgctcttcagtgtatttgctggaccattttttcttcgacattcggcgccacgcttgttcccacggaagacgaatatcagtgaacagataataaatctttgacttatatttgttcaagaacatataagccgctttattcatcttgttctcttcaccaccgtagaagttcagagaagcattaactaccagaactcggtcatatacattcgggtctgggacatcatcaaatgcgatgccatattgagtatttttcattgaaatgaggtcaacatcaagccccatatcttttaagcattcggacagataaattgtctcagaagcaggggttgttttaaacccctggatgttgttacctaagttcaggatagcaattttcataaagtaggctcaatctcactgaattttttgaaagcatctgacttttgtttcttggctacgcacatacgaagtactttcagaggctcgtcagtgccaaacatagttttggttgggtcaccttctgatttccaacgagcttgagttgggaagtcagcatgaattttttctaatgcgcggttttgtttagccgcattacgcatagatgatacgccgccaggagcttgtcctttaccagatttgacgagatatttgaaaatcgccagatgaggataacccatattaatgagtttaaggaatgcgtatgtatcttcggacaggtctactataccatatccaatgtcatcggcagaaagtttgcttaaatcgtaaaaagtgttagtgaatccataagagttctcacggaaatgaccccatttagaatcaatcttgaaaataggcaaacgagcatggccgtgatagaatccacagtccatagctgcttcaacatactgtgtgagtttattgaattcgtcccatgtcattccaacatcatgaagaatacgacggtcgtctttagcacgaatctcagtagtatgaattgtcgtgtcgtcgtccagcatccaaattcgttggccttgatacatttcagtaatcaaacgacgagtaccagcaatgccatttacatcatctggaataggaataatttgtgctttatcaccatagtaggcgatataatcatctttctgagactcacgaactactaaatgaggtacataaccagtagggaacatatccagggcagtaactgccccgacacgattgtaactcggaattacaaattgaatcatttccatttgcctttgtagtcagatttcttaacatcaatccggccggtttgacgataatggtcaaccagatagaaatgacgctcatacacgtgcagagacccagcgttccaaataatgtcgcctggaacatatttttcaccagaacctgcattaactgtttctactaatgattctaacacatatttctgccaagcataatcattgcggaaaccaaatacaacatcattgcttcgcatattaacgacagcgtttacacgaccatcacgaataagatattgaactgtgttagtgcacatgaaatcactcataccatcacgttcaaaatcaacttgcatacttggacgagtgtaaatcataattgcacgacgagaatctggtttttcaatcagctcagttgcgcagaatgagaattgattatagttttcagcagaccagattgcccagccatagtttgagttaatttcaccctttgaagatgaaacttgttcccaaattgctggagtaccacccggaatatctttcacgaacagagacttggatttgtaccacgcaagttcacgttcaacatattcttggttaactgttccgaaaattgaatcttcggttactacaaaagacggaccaattaactcaatggtctttgcgccagttttgtcaattacaaacatttcattgaacagagcatggcacagttcatcacgaatatcttcgttagtcagtggagttacaatcattttgcctctttatagttaactttcatacaacgtttgaaagcatcatattgaccacggtcacggaagtcttcaaatgcgttgatgtttttgatagtaggattattatacatcacttgatacaattttacgccatgtgcttcaacaataaactggcatttctgggctgctttacgctgctcataggttgcatcgagttcacgttgtttttgcataacacggctttggtcgcgagctattgggtcattagctcgttgctgagccaggtattcttcaccggcgcggattgaagactggttcacttgtggagttgaacgagagtatgtcagacctgtgccaccaacatacttaacttggccaacagtgtcagctcgaacaatttctccttgtggagcaacacaaccagttaatgcaaaagatacagctacagcagcaagaatacgtttcattttattttcctcatttatggattacaagtttataagtccaatcattatcatcttcacgataaacgttgatgatagatgtttctttaatcttagcacgcagagttttctctgtgatttctgtgccgtcatcaaagaaaattttatcagttccgcctgaattcaagaagcgtaaagtgcttctgagattgaacttcagtactggaatgtagctatcatctgtgattgaataaatcatttttgtctctccgtgttaacttgaaagcattataccacatccatgtggtgatgtaaacggttagaaatcgaacatattctctaacgatgctttttcttcgtagtctaatcctgaagcttctgacataccagcaagtggtttaacgaaagacttctggaacagagtcgtgtagtccaaccaagccagaacatcttgacgaatctcttgcggaagttcagtaccagatggccatgagatacacttgtccccaaatgggttaccctgacgaagtggaagaaccatcaccttgttaccctcgagaatcggagtgacagagaatccggccgttgcacggttataagtcaatgcaccacgaacgtgatatggacatttcagaccagggaaaccattatcgtcatatttaccgatgtcattgcatgttttaacttctgcgataactttgtagtccagctgacgatattctttctcaaactgcttatagtattcttgtagtgattcttcaccttcttgaaccatacgacgaatagcttcttctaatgcctcttgaacagcttttggagtagaagactgctgagtctccatacccatgattttcaagtgtggttcagcataacgcttatcttccatgtcataaacgttcagtgcataacgttttttagctttccagaatccaccacaaccttttgaaccaagcggaggacaagaaatagcttctcggtccatgtgcataagatgttcacggttattgaagtattcgcacagttcacgataagcagtatcaatcatcggttccattttcttcttaccgaattggttcataaattcaaccacttcgtcagtcgttttgaaacgttcaagacctactttttcaataaccttgtcaactgaaacgtagattgagtcagtatcacctgctgcgatgaaatcaaatccttcggttccacacactttattcagatactcgttaactttacgagcaatccaacgaatacctacttgaccaaacagtgtaattgcagatgcgttacgaaggtcataataacggaagtagatgttacccaaagcaccataaagactgttgataagaatcttacggttcaactggtttgtgtttgctagaatagcagcagcttcacatcgagccagcatagtttccaacaccgacttcgtgtacttattcagagacgctttctgttcgtcagtgtactgagtgtaacgagtttcatctggagtatcaatgtcaccgaatacgccagctgccagaactttcttaatttcttctgcgttacgttcttctgcgaacatctttttcttccaatctttacgctggaagaataccttagcgatttctactgggatgacaccttcaatatctttacgatacatccaaccgttcggtgagcaagaatactcgtcacttggacgtggtgcagtcttattgatataagcttcaatatcataaagtttgaattgaccaacaatagtttccggagaaatattcacctgacgaatgatactcggatacagagatgttaagtcaaaactcatgatgtacttacgagcacatgctaatggttcaaatacatatgcacctggataactttgcttgatatgacgcttaccttgaggaacaactttgttctgttctttcagggagttaaagataattgcgtcccaagttttaatcggagacattacaccgccaaacggcatcttggcataataagacatactaagtgccaggtcaatgaatccacgaactcggtcaataccacctacggactcaacgtccataatgttatagctaatgtatcgttggtgatttgtttcacgaagtttgttaattggtccatcgtacggcaacttaccacgtttagtttcatactgtgcgatgtaatccaagttataagttggttggttcgtgaacgagtacttcttatacaaatccatgtaatccagaattgttacaccgtcgatgctgaatacttctttttcaccgtacatgttctgaatgagttttgaattcactcgattgattggagagaatcgtttcattgaacgttcacccaatacatgcttaacacggttcatgatgtatggaatatcgaagccttcaatgttccagcctgtgaaaattgctggacgcttttgttcccagagattgatgtattccagaagaagttctttctctgaatagaatggcatgtacactacacggtcgagaatatgttgtggaacttcgtctccaccttctttatcacttcgtgcagctaacttcgcgtcccattctgaaactgagccatacagagaatctaacaaatcgaaaacgtagaacttatcatcgattgaatcataatgagtgattgcatcgatttcgtacatagctttcattgggtctgggaatttatcacctgtaacttcgatgtcacagttagcaacacgaatgaatttcttgtcatagacaatttcagaaccataagtgtcagagatataagcgagtttgaagtcatccatacccatggcttcaagaccgatgtcttccatacgacgaatccaatcacgagcatctttcatggttgggaatgtgttcttgacgcatggtttcccatagatatcaaagaactttgtcttcacaccttgttgagcatgagaaaacatagttggagaatattcaactcgtcgttgacgttctacaccattggagtcaatataacgttcaatgatgtcattacctgcggtttcaatagagatataaaattcttgtgccatgagtttccttagtttttcctatagaccgagtgattggtctttggtatgtctattatactccgttccgctgatagcagaaagggcccgaaggcccttattaaatttgcgcaggttcgtattgaactacaccttcttcatctttccagtatgccatgaaagcataaccatcaggatatactcgttttccgtctggagtcatagcagaacgaagatgttctttttgacgttcaatttgttcttctttagtaccttcaaccatctaaacctcgataacttgtttttggattcgtggatgcctgtttttatcataagtaaagcataacataacttttctatcaggaaacttttctaatgtttctttaacttgatactgaatttgctcatcaattggaagactaaaccaatcaggagctttaatcttgatgtttttaagtttatcaagaaactcttggtctgtcatttatgcacctatcgtgtattttgatttgagagtccattcagatttctgctggaatgtgataacacggaagttattctgcatttcagcaagatgaacatccggagtcacgatatcaagtaagccccatccttgtaacagttgggcaattgaatctcgacggatgtagtcttcagaatcgatagtaacaggacgaccatcaagcttcaacatttctttaaagtgaacgatgtagtacttgccctgtttctgaagaatgtggcaactttgatatagtaccttatctttgttattagcaatacccatacgagttagggtttctttcactttcagaaaatcttcaggttgtttcagagtaatttcaatcattttaccattccaatgctaattttttaagttgcttttgttctttcacgtttttggtaatgcttttgaccagctcatcagtcactgcacctttaagacgttttaatgtctcagacagtttatttttgttggctagagtcactctataacgctcagcgtcattgatattgattgtataatgattcatcaatactttcagaatgagtgtctcctgggcgctctcgtttaacttagcccacttaccaaaacggcgtcctcgaggaacagccgctttcagataattgaagtgagcttcatctgacaatccagaaccaactaaattcatcacataaactgacggcatgcattctggaaattgagatagagcattttctaccatgaacttcgaataatcacgagttccgattgatatatctttcttctcgttaattgcaccgattattgcgaagaattcattttctgctgtttctttgaaagtatcagagagacgtttaatctccgcctcatctttactataccaagcaatctggtgttcgttcagctgaacgtcatcttcgaataaactcatttgaattgcatctctacaacaagttgcatgaacatataagttatgtgcagttctgtcgaagctgctacaccatgatattgattgttctcaccgacaatctcatacatcctgatgatacttgctttatcaactttcgtgtaaagctcgttagcaagtttctcgataaaccaagaataattagtcgcatacttaggagcaagtgcacgaagttgtttaacatcttttgatttcagtgcatcgataacatcactgatatctccggaagtttttgtcaccaaatccagaattcccgagtcaataacacccttggaagaataatggtccaaatcaccaatcgtcttacgaaaatctgggaagttcttgttaaccaaagccgcaatgactttaaggtcttcaaccttgatattttcatttttacagatttctacacaacgacgaatcatttctttcatcatgttgcgtttatcgtcatcagtcgcttgaccgaatttgataacacgacaacgagattgaagtggttcaataataccgtcaatgttgttagcagtgatgatgattgtacagttgcttgaataagcttccatgaaagaacgtaagtgacgttgagattcagcaagacctgaacggtcaaattcgtcaatcacaataactttctgtttaccagataatgaggcagctgttgcaaagtttgtcagcggtccacgtacgaaatcaatcttacaatctgaaccattaacgaacatcatttcaacaccgacgtcgttacaaagtgcttttgctaaagtagttttgcctgtacctggagacgcagataccagaatcatatgagggatggtgcctttcttgatgatagcatcgaatacttggcggtcaaattccggaagaatacattccgaaattgattgtggacgatatttctgctcgaagatgtgttctttttcgttaatgcttaacataatttcctcatattgaattaatcaaatcagtggatggtccgaagaccatcctatcacaattagaaatcgtgagtactatctgcttccattgctactacataacttgcatgttcaccttcgaacttagcagcagttttcttaccctgtgcccagagcagcagtttataatcggcgggctgcatcttcatgttacccatattgataacaaagttgaagttattagtgccgtcataatcgccgagagtcagagaatatttggtacgaaccagagcagaatcttctaccttattgaaaccgttcagaacaatcttaccatctttattagtgatggtgattgtgtcaatctgcagaccacgagatactcgcatcagctgttgcaggtcttcagatttgaagtcaacgataacagaagcaaccgggaatggaattggcttgcttgggaatacgatagtgcttgggtcagctgctggccagaaaatggttgaacgagcatcggcaattttgatgttaccgtcatcagccagagaaatttctgcatcttcattaaccagagacagaataccaaggaagccgttcagttcataaatcgcaacttcaaaatcaatctcgtcagcgatagttgcttcagcgtaagttgtaccattaactgcacgagtcatgatgaacttaccaggtttcagcataatgccagagttgatagtagagaagtttttcagaatattcagagtttctttagacagtttcatgtttttccttagttcaattcaatttcagtttcagatgattcagattttacaacaaatggagcgaagctatcataaacttcttgagcaactacctcagcagcaacgagcagttgctcatcagcgttagtacagaattcgtcttccagacgttcaccaccgaccttatcgagaataactttagcgccagctttaattgaacggtcataatgcttacgcataatttcaatccacttttcggagattgaattatcaacagaagagtaataagcgaaacgaacttcagaatctggcagtttgcgtttaatagcttctttaatttcttcaggcagcatcagaacccatgctcgacggattttattctgattgttaggattggagtcagtacgtacgtttttaggttggatttctttaacatcagtaacgatattcagcatattattttctcattcaaaaaattcagaaactgtccaagcaggatgcctgttggaagatattttatcatactgtttaccgaaagcatcttttaaatgctgttcggtaacgacatgctcttcaccagaaaaattattagtgagaacatatcttttaagttcagggaacgttagtaactcgttcccggttgcgtattgtttcattccagtaccgtaaagcgaccaactttcttcatttgaaggtgttggccgtatgcttgagggtcatggtctcggtgagaaattataaaaatatttgaatttggcattttactaagaatgttattaattgctttaacaccctcagcgtcagtggcggagtcaaagatttcgtctaagaacagacagcttattttaacaccagataccaattcagcaatatcgcgccatgtgaataacaacgcaatatcaatacgagctttctcgccttgactgaaagagttataactaaactcttcacgtcctcgggatttaatcgtttcgttgaactcttcattcaacgtaaagacgtaatccgcatccattatcttcaagtacgtattaatctgcttattgaatagaggaatgtacttcttaatgattgcgcctttaataccagaatccttgaacatttccgtaagaataccacgttgatatttttccataacgatgttggatttggtatcaactattttattcaattcttctgtaagcgttttaatttcatcagaataatcaataaattcttcagctgctttatcaatagctgctttaattttgcgaattcgttctactgatgctttgagttcttcagtttttgaattaatctgagttttgatatcacgagctctacgcctgacagcttcgaattcagtctgggacgcctgaagattctctagatgtgtttttaactcagcatgtttgatattacattcatcaactttagaattaatctggccgattagagtgtcactggcgtgtaaatcctgcaaacatgtaggacagtgtccacctttatcatacaatgacaaaacttttgtataagactcgatacggttaaggatagttattccagccatttgagtcttctgaattccttcagatacatcatcttcttcgccaatcacaatgttagcaagattagcattcaactcatcaatcacactacgaatagatttagcgtcagcaagagattcttcatacatcgttttccaacgtgcaacgttttctccagaaagtttcttttgcttctctatgttttcttcatagattttgatttgttgctgaattccatctttcttggcatcaagaacttgaacctgagaattcaattctctgacaagagctttattcaacttgtccatttcagcaatgattgaaacttcaagcaggtcttctactaactttctccgagcgggtgtactaagacccataaacggagtgtagcctgctgttccgagtaccacgacctgcttgaaactcgtgtatgacattccaatgagttcttcgaaataactttggaagtctttaactgaagctgcttcatcaagtttagcaccgtcgcgttcaatttcaaagacatttggtttctgtccacgtttgatgtaatacgaatgaccgtcatattccatccacaattcacacagcaatcctttcttgtttgtggaattgattaattgacctttcttgaaatcacggaacggtttgccaaacaatgcgaatgtaattgcttcaagcattgtacttttaccggcaccattcttaccagtgattaatgttttgtggaccttatcaagttgaatatcaatgggctgtccgcccactgacataatattctgatacttgactcggttcaatttaaaaatcttcattgattctgagcctcaacataaagagcttgtgcaaattttttcaatgcagcattatcagttggagacaagtcttccaatgcatcaatatattctgacatcaaatccaataagcttttaacttcgatatcttcttcatcgtcagattcaactgaattgtcaatcttagaaaccatacgaagctcgtgaactactttttcgagttcagtttcaaacttcgtgatgtctttatcaacatcagtgacaattactcggactgaaagatttttgtagtcgttgtaatcaatcttacctgtgaatggatattgaagtcttacatgccaagtggtttcgtttggcacaaaatccatactttccgttgcggtatcgaaaatccagaatccgcgagggtcgttctcgtcacctgctgtaagggtccagggagtgccgatatacttaacattggcagcagaggatatagtatggaaatgccctgaccacacttgcttatatgacttaaggaaatctggctcgagaccatgagattttaaacctttgtagtaatagaagccattaagctcccagtgtccaatacaatactctgcagatgattctttaacatgcttcataatagaagctacgttttcgtcacaaagccatggaattaggtcgattaagcatccatcaaaatcaacagtagtaggcacatcataaattttgatgtggtcatgtttgcccaatacttctgtgatagcgttaggatgaattttattcttataatgcatatcgtggtttccgatgattgtatgcatcgtaatcccagcttctgctagcatatcaactatttcacgagcgaattccatcgtcttgtgagtaatagctttacgtacgtcaaaaatatctccatactgaatccacacggtaattccatgcttcttagagtactcaattttttgacgaataccatcacgttgaatttcttgaagccaagggtcatcaccctttacgcccagatgccagtcacctgtgtgtaatattttcatgttttcacctcaaagagattatactctatactccagaaagcagaaagggcccgaaggcccttaattaaaatccgtcaaattcatcaaagaaatcgaaatcttcttcatcaaattttcttaacgagaacataacccaattcctcggccaatttcttggcttcgttgaactttttcaacatttccgtttttgaattacgaatagcttcataatcaatttttgattctggcttttcagatgaattgcagatattacaaaatatagaacgctttggaccgatataattgataccgcaatctctgcatgtgcacatataatcgccagaagaccaatcttgaggcttgctgcgaggcaacattaaagtttccaccatggtttaacttggagagtatcaacccacacaacttctttaggagaagcttttactgccgggcctgtgcttccaagaacacgataatgagtttcggatagttttactgccatgactccattggaaactgacagagtaaaacctgcattaacttttaaacgcttaaacggtttttgtaccagcattgatgatttcccatacttgttggcgtgtagtctgccagttaacacggatgatttcgtcattataaggttgtttgtaaatgtcacgcagtttacagagagcgtacttatatgcttcgaaattattttcgaggactgcgccagctgcatggtcattcagtcgcttaatttcacgacgattctttttgaagattttagtcgccatagcatttgcacgtctctggctttcttcttcaatcaaacgtttaatacgttcttcttcgttatcgtcgatttgttctacgctgtcaatattacgttcgttcatttgacctacttacttttgtaatcaattgttatgctaaaatcattttctcctagattataactgtgagttatctcagcattatcagaagtgaattcagcgtcatgtgggttcttggggtcgatgtgaatgtccaaatccaatacctccctcatatacattttaagcaaataagggatagcatcgtaatcgggcacttcttccaggaaacctgcgaggttaatcgtcagcctcatataaaaaatccaagttcggaccttcatctacaacatcgctctttttgtcagaccctggctgtttgtaggtggaggtttcgtaatgcgtcattttatcgtagatgtcttgaataaaagtttcatctaccaacgcaaccatatcatcgtcacgagcgtcatagacgttgtggacaaaatagctgtactttttggcaacttccttacgttctttcttgatacgttggacgaatgcgttaaagcaagcacgggttatatacgcatgcgggttgtcgtactttgtttcatcgaagttgtgtagacctttgatagaagcttctacaccgtctgaaatcatttcatctttccaagagcgggtgtatcccgaaaagttaaaacgcttactcagaccctcagatatcaacataattgctctgccgatagtatcattctgccgaacgggtttaccagcttcgcggcattgctgtttccactcagtgatggctttcagcaactccttattatttacatagttagccatattacctcttccgcttcatttaataagaatattataacacgtttggaggaagggtattttaagcatctatttaaggagttcgtaaagcgaaaagcacttaatcatgagtttgcggaaagtaacaaagtcaagttcaggttcaaaagcattttcattacagaatctgagccatgatttccataattcgatgtagccattttcattcagcttagatacatggcctcgccagacatattcaagactaggaccaggttcatttgagtctgagaatgtaattcccatccacttatcaacgaaaaattcacccagcccagtaacacggaatgaggcgatttcaatatcttctaaagtgatttggctcataggtcaaataccttgaatgtgtcttcgattaaagtcttgaacgtattgtagtgcataggttcaaggtcttcgcaagtttcttcacaaaattcgcggtaaagaatatctgaagtgtaatcgcggaaaatagcaatatcagattcccagtaagcaccagtctcttcatcagagaaataaacggtaccgtcacggcgaataacccagtcgccgtagttcaatacagtgagcatgatttgattgtatttcataggacaagttccttagcacattcaatagcttcatccatacttccgaatgcatctactgagtgataatctttcccagtgtattcataaacccaccaggcgtcaaaatcttcttcaataacaaaatcaacatcgttctttgaagtaccttcaatcatcaagcggccgtcttcagttcgctttgtttgaaatccggctagctgcaggtcactttcaattttattcatcaaggtactccttcagttcttcttcggacattccttcttcccacatatgataaaaaggataatccacatttctgtcttgaactgggaaatatctaacatggaaattttcgtttatcatttcgcatgctttgagataatcaacagcattattgatatcttcccaattagttccaaagacgaatcgagcgtgaagcttagcatgccaaacgtctattttatgagatatcaatatgataacacttatgccttcattcatttggcggccttaacaatcttgaggtcaacgaagcctttcttacgctggttcttcatcttacgaatagtgctgtcagagatttctttacgctttgtagttggaataccgaaagcatcaagattaaattcggacagaatgtaagcaacaaccagttcacggatacgagctttaccaattttctggtcattttctttcatcgtaccgtgcagttcaacttcccacttatccagcaacttaggagtcacgataacgtctttgaactcaccatcaactttcattgcttctaccttcgggaatacgaaagcgttcagtacgtttttgatagcttgtgacatattgatttcctcattttaactaagtttgacataagagattctattccaaatcccttatagcaaaattagcagtttttgacgtattcgtagatagcacgagtcagttcagccgcttcttctttttcaatatctgaaatcaaagcatagatagcatttgtgattgaacttggacgatggcgcgctgcactaattgagacttcagtcatgcatgaacgcccacgaaaaactacttctacgttgttgatttcaacgttcatgcgttcttgaccgcggctttcggaacgaacgaaaactcctaactcaacagttaccttctttttaagtgtaatcatgttactctccttggttggtgtaagagtatagtaacaccttccactacagatgtaaacggttgatagaaacaaaaatggggaccgctagggtccccgaagatgtgagccatatgtttatatggacttcaaaagaaagtgtcttagagttaatccagtgaatcgaggtcgtaacctagttcgccaagtctctcttttattgttcttagatttgggtaatatacaccaccgaggataacgaccgggtaattgacgcgcttgcttgggaaaactcctgaggctttagcggcttcttcaatcgccttgtagttgtattggacttcaccggccatgtaaataacgtcgatgaactcatacggaattttgaattcgtcaaaaatttctttgactgctgcgcaaccagcgcagcgatagacgtcttccggaattccataaattttagctcttagttgtgagttttccattaactgtcacctcgagcttatcatctaaaccaatatctttaagcgcatcagtcattcgacgaatacgcgcagtgacttcttcgggagaaagtttaggtttatcatcggtcttaggagcgataatcactgccagtccgaataccaaaagtgcaggtacagcaacaataattccataagcaataacaagataagccagaagcttagataaagcagtacgagtcccgttgaagaaagatttgatgtatttcatgtttttccttaggagaaagttacgataccagcgaaaacgtacagagcagggaattcttcgccccagctttgaatgatgaagtttgcgtttagtgcgagtttattcaggatgttcattgtgttcctcattccaagttccgctgttaatccacagcctttgattgtcactgcctctccaaagctttttagttggtagagactgttcatatttaccatcgataataacatcaacataatttagcagttccaagtccttgatatcttcgaacttgtagcccgtccacatccaaacatctttatgagggtgactagtatgtaagcacttaagcagtgcttctatagtttctctattgtctggataaagagggtctccaccagtaatagtgattccttgaatgtaatcaggctcaagaagctctctgatttcaccaatcgtttcaccggtgaactctgttccattgcgtggattccatgtagacttattgtaacatccttcgcatttatgcaaacacccggtgacgaaaagaacgaccctgcaaccagggccatttacaaaatcacaaggatagattctgtcatacttcacagtgttttgtcctgtgcattatttctttatttttaccaagattaaatccgcgttcagacggattgccaagatatccgcaagtacgtcggattgtgttcatctttttagggtctgattcaccacattcatgacagacaaatccatcttccgttggagtcatttcatgagttgaaccgcatgtaaagcacttatcaactggcatgtttacaccgaagtaatcaagatgctcaacagcataatcccatacagcttcaagacctttaaggttgttcttcatatcaggaagttctacataactgatatgaccacccttagcgatgaagtggaaaatagcttcacggtcaattttaccaaatggagaaatcttttcttctactgaaacatggaaactgttggtgtaccaccctttatcggtgacgcctttgatatcaccatggacttcagcgtcaatcttacagaagcgatagcacaaattctctgctggagttgaataaagactaaaagcaaagccagtctctttagtccattcagcaagataatcattcaggcatttcagaagaagcttaccgatatcagcacccaatagagtttgaacttcatggattccaatatatcctaatgaaattgaagaacgaccatttcggaagatgtcgagaatctcatcgtttggcttaagacgaacaccaaaagcaccttcttgataaagaataggagctacagaagctgttacaccacgaagtgattctatacgtgctaaaagagcttctttacaaatcttcaaacggtcatcaagaatgtggaagaacttggtcaagtctggacggccatcaaccatacaatcgagtgctactcgtggtaggttaattgtcactacaccaagattattacgaccatcgagaatttcttcgccgtctttgttcttccatacgcccaggaatgagcgacatcccattggagaaactggaacagaagagccagtgattagacggttattctttgaactaatgatgtcaggatacattcgcttacttgcacattccaatgcaagttgtttgatgtcatagttcacatcagtaggatgaaggttaattccgtcctcgacaaacataacgagtttaggaaaaattggagtaattccgtctcgtccaaggcctttaattctgttactgagaatagctttttgaatcattcgttcataatcgcttgtaccggtaccaaaggtaattgtcacgaatggagtttgtccatttgaactgaacagagtattgacttcatattcataagcttggaacgcatcgtatacgtctttttctgttttctcaatagcgtatacgtaatcattgacatgctcaatgccgtatctttctgcatcgtgtaaatgcttaaagaaagtcttctctacaaaaggagcaagtacaacatcaacattagcaaatgtcgttccaccatattgatgtgaagctacttgagcagtgatttgagccataatagcagttgctacaccaattgactttggagtctcaatttgagcattaccaagtttaaatccattgctgagcatacccttcaaatcgactaagcaacagttagtgaatggaagagctggagaatagtctaagtcatgaaaatgaataagacctttatcatgagcatttagaacagtgggagagataacctgacgagcaatgtgttttgaaacaattcctgccatcaggtctcgttgagttggaaaaacacgagaatctttattagcattctcgttgagtaagtctttgttggtgcggttgattaaaccctggatttctgattcaattgtcattttaaactcttacgaagttgctttttgaatgaagcaacaagctttggtttggaatcatcttcagaataggtaaacccgtaagcattcatttcagctatcatctcgggtttaccaagtcgactgaattcttttgacttatcgccaatgaaattaggatgaatgttgtttttagtatagtcattcttcagataggtcagcaaactctcaagccactcgaggtagtcgacttcacgacctttcaaaccagagcggttgaacttatgcttcatttgaccttctgctgcgttacacaaattacacagtaaaccacgaactttaccagcttttggcccgttcaattcatggtcgtggtcaaggtggttactttgaacatcgctgtctaattcgcgtttacaaataggacagataccatgctgtgcatcaaatagtctttgtttttcttctttgtagagtttgctagtcaataacatagttcacctcagtattagatgaactatttatagtttagaacttcctggagttaaattcaagttgagcttcaagccaacgaatataatctgcagcagcttgcatcaaatcgtattcttcggaatcacaattttcttgaccagccattttatagagctgcgcagtgatatcttttccgttaaaaaggttacgagggatatcttcagaagagccgtattggtcagaagaaagttcttcaagttcttctaaatgatcaatttcatcagagtagaagcaccagaaccatgaatcttgaccactaatttctggatgagtagcagttttaacatgaacataagggccgttcttaaattgaacagaagtcatgccagttgattcgcctactttactgatgctcagaactttaaattccgcaccctttacaaattcagggaattgagaaagcagctcttcatcttcttcaattacacgaaaaactttattcaggaaactcatatccaaactccatatcgattaattcattgttggtaggttcattataatgattttcaggaaagctttcttcttcctctggctcgagggtttcccaacgagccgcgtaccaaggttttagagcgtaacccattctgtgatagtcttagttacaacgcgttcgcgtttttcaactagtgaaacatcaggttccatgtaataccagtcagtgtgatacgaaccagaacgagtttcatttacagcaacatgaacgtcatgtttcttgctgtagtaaactacttgacgatattgatacttgtgattctgagtccattcatcatggtctacttcttcaagataatcagagtcttcaaagtcgtaatactctgaatgcccatcatggtcttccatgatttctttcagaattttttctttcatttcagaagtcattattcacctcgtaaagtttcaagaacttcatcatcaacccaagattctaaaccacttggaagagaacgttcgacttcccaaagtaaagcttcgcattcgcgaagacgagcaagctcagcagagcaaattacttcttctgtctttgggtcaatcaatacagagttcagactcatttcaaatattccttcaattcagtaaatccaccgataggcgaacctttttcatcaaaaatctggggcattgtcagaccaacacgagatggtctattcagacgcgtcagaagctcagagataacttcttcattaaagattggtgtaccatcttcattattgcctgaagtcacagagatgaactcgtaatctttacgtttagcatctaacagacgcttagagttaatgcatggaacacatttaaaatgcttgctgtcgtaaccgaaaaccttgaatgtcactagagatgtcctcaataactgatgagactactttatcgtagtcgggatgattttgtgtgcgatggtcccatttaacaccaagacgttttgcaacttcacggttaattgagccaaacgcaaatgaatgagcacgggttaaagcactcttcaaaactgaataagaatccggcattttaccatggtctttatgataagctaccatcattcggaggaggctgtcttcagcctcaatcatatattctttacggctcatagttcttttaatctcttataagactcgtgagctgcaacagcaatcttttcactcattggaagagaagtgttaggttgactattcaattgatgatatgcatatgttttgaacattataacatcaaaatcaattgaagcgtgaagagaacgatggacatggtccatgttaagattttcacctttttcttcagcgtattgaagacaaatacgcccagcaacttcacgaagctctttaaacagagatttcatctcttcagtttcagaaatagcactactttgaaatggattcatttgaccgccttaacaccaggaatgttgcggatgacttctaacacttcgttaaaatcgtctttgttgactgtgaccacaatagtgcgagttgtttgcttctttttccaacgcttaaagaaagtttctaaacgaaggtcatgagctgtaaaactgtcttcatcatttttatagacgtaaccagactcaattgtaactactgcatctggagctgggtcttcataatcttcaacttctacaccatcaaacagaatcagtgtatcgtcatgataatagccttcccagaagacttcatcgttgtagaattctttccaaagtgcaccggtaattttcatttcttcacctcagggaaagctgcagcgatacgttcagcaattgctttatcgagcatattaccaaagtgattattgatatgagaaacaatcattcgttcccaacgttgttcagtcatttgaagagtttcttcaatgcggttttctaattttttagcagcttcttcaatacacttagtaattttattctgaataatattctgagcaacttcagtagcttctttccgcattgcagtatctaactcaaatgttgagtcatagttgttccaaccgcgcttagtgaaaaatgctttgagttcagtttcaacagcagcttttactgaaggaacacgagcaccaagtaactcaatttcttgtgaaactgctttacgaattttgttatcagaatctttaagcaccatctctttgacgatgttctgaataacagactgttgtaaagcagaacggatttcagttccttctgggaacagctgacgaattgtattggtgtctaattttaaatcaatgagtgacataatattttcctcttaaatatctgaattcatccaatcaatagccgatttaggtaaacatcctatcacagaaaatacgaaagcaaaaacataagtcacaatgtaaaggaagaaagaacccaatgaccaggcagcattccagccttgacgatattcagaatagattagttctggtcgtatttctaaatcgtatgttgaaccaacacgtgccatgctataaaatgcaggtgaaatttctcggtcaaatcttcgaccattttggtcttcgtaaacagcaatgaattctagatgagaatattttcctgttgaagttccagaataaagttgaactaattctgctttaatgagctggtcttttgaaaagtcaggacgcacatcagtgaaaatagagaagcaccaaaagcaaattgctgctacgagaaatttcatacgagttgtcattttaattccttcacaaatttatgtttacaatgacggcatttcatctggagttgaggagtttgccaattaactaattgtacttgaacactatcacattttggacaaggcgtaacttgtttagcagcagcttcacggcgttcaaccatttccatcatcgcttcccagcgagtagcggccagaagccgctcaacaccttctgggtcatcaataatttcttgacttaagtcaatatcttcatgtaattgctttttcatacgccagccttaggttcagaaataacttctaatgagattcgcaatgtttccatttggcgtttcagctgaatagtacgtgaactgattcgtgaaacttcgtcattaagattacgctttttcgtttcaagttcattgaactctttttcaagctcgttaattttcgctttaataactttgcttgcatctataggagtttcaacaatttctttaaccgtgttaggagtcacaattggctcttctggagcaacgaaatcttcctttttcttaatattcaagttaaccataatttgatgctgacgtggcgtttcaacaacaagattatagaaacggacaatattcattcgtttaagagctgaaataatctgcttagagattcgttccatatcaccattttcacggccagcacgaatggtgatagtcattacatcatcactttcttcaataaacgaaattgttggaatagtccatttactagttgaaagcatgaagttagttttagctttgtcgttttcagtcagaaaagctgcacccaaacgtaacagacgaggaaactcaaaagaaaactgattaatgatgaaattaacagcgctttgattatgcattttatttgtgtgcacattagttttatcaccatcagcgttataataaagagcattgtattcgtcaggaacttgcattaagtaatgacgaagacggttatttgctttaacacgacggagaattccactggtgcgcagtacatcaatccaggcgtcgggtttgttcgcatctccagcagttattcgcgcagcattgatgcgagcatcaattcccattttgccaaattcagtgtttaaaatggttgaaatccactgacgaatacatccaagtttttcaattcggtcagctcgtaatccttcgcctgggacgaagttgaaagacgtttcagcattagcaataagttctttgatgtaagtattgaaattgttgttggtcaatacgtttactaatttcatatctattccttcattgtcaggcgtaaatttgattgagaatccgtgaaaccattatacatcacggattttaaagcattaatcgaagatgactgcgcaaatccaaaacagcggccaagttgctactttaaggataaaaataacccaaaccactggccaaagcatcataataaatgcagcagtatcaccatcaatgtcgatgaaccagtcttctacaagcttaaagaatccagttgatactgcgccgatggccaagtaaaccagaatagctcctacgatttccatagtatttctctcgcttcaatgatacgaagttgtgcttgcttgtaagtataaactgcttcttttagttgagcatttgaaacttgaagatggtctttataccacttgttcaagtcctgatgctttttaaaagtttcaacaagtttgttatttgcttcaattaaagcttcttgaagtttatcaaaagtcttttcaataacttcgcgctttactgaaccgtcatagttcaatttacaaagaatgttagcatgacgccaaatttctctgagttctccaaggacgtttttcttatcaccccaagtgaacttataaagctcttcacaaatagcttccgcctgcttttctgctttacttttagccattccagcgtagatataagcaggaggataaagggccgtgttatcgacccagttagaaagaatcagcatataaccaccttagttggacgcttaaagaacgaatgagtactatcgtctttagcatgttcaaaagttgcagagaattcaataattccacgataatccatcggaactgcttttggcagagaaccataaacagtagcaccgttttcaagacggacagtcattttgacttgcatcccgtaataatcttcccagcacttaactgagacgactttgcctttaactacttgcttaccaacaggtgcttcgcctttgttctttttgaacgattcatacagttcatcaaagaacttcttagaagcttcttgaatagccacaagaatgttcttatgagctctgacttcaaccatcataacagtggtgaaatcttcaagttcccaacgtttgtaaggttcacggacctcgatagggcatccgtaaagtttaagttcaacatacattgctgcagttaaacgaagtttccaccatccatggtctcttgtgtactctggtttgtcaaagtaatcaagttccgtaacgtatggaagataactaccagcgtgatatgcttccacttcgccaagttcattttcccagagataaccatcgaacggagcatgtggacgatcatcaattccccaggttggagcaaccaccttatcaaatccttcgcgaccgtagcgggtcttcgcccatccagcattcaattccaaagcgcgttcttcaactttcgctcggcgtgctgcgtgtgctttacgattttcatctaagattgagtcgatgatttcagttagcattttgtttctccgttggttgattacgagactatcatatactaactttttagtgttgtaaacggttgaatgcggattcaccagaacggttgagaggaactttcttgcgaaggatgataaatcatattacgaggatacaaaaatgccccagcgaagccggggcgaactttagtgataagctggagtattagggtcgcctgagaaccacacggaagtactaacctcagtggctttcatttgagtttcaaaagcctcttcatttattgctttttctttttcaaacagacgctgcgcatggatttgcattcggtccatttcaataagcccaatagtttttaggcgaatgaattcagactttgcagccattcgcccttttatatctatgacagttgggtatttaactaatagctcaaatcctctgtcatattgtttttcataaagctcaactgcaccaaccattttgcgaatgaagttgcaatgaatatctgatagccgctgtttgtaattcttaatgattaaatcttttaaattcactgcttccactcctctgttcgacctattcggtccgggtgacaattccagaaatagtccttgcacttatttccattagtgcgacaaaacttttgctggtatgatttctttttaaatggctcaccgcaacttggacatactaatgtagtgccaactttcattaatgcattatttcggtagatgggttccatgatatcatacctggttgttgtggccttcttttgaggactttgactactatgctctttgacttctgtaagctttctttctcgagttgtgctagtcctttgactactgttgagaagtctgaggacttcaattcggtcaccatgcaagttgatgggtcgaggctcgtgaccatattcttcattttcatagtcttcgtcttcataatcatcataccaatcgtttagttcatctaatccgtagcccatttatttacctacaattaaaacaccaaccatgaaaataatccagaacggatagaataaaatcatagaccattctgctaaccatttaactactttttgtttagtagtgcgacagcttgaagctggcattccaagacaccaagcgaaagttctgagaaaggcaactccacccagtaaataaaccactattgccaaagcaataagaactggaattaccataagtctttccttaatagattttcaacatcacttctataaactgaagcagaagtgataagttcatcgtcgaacttcaattcgatttctaatgttccaaacaatgaatcattgcggacttcaattgttaagttctctttaatcatttcttttagcaaaactctcatttcttcgggattcatagtttcatctcaattcgttctttgcttttaacaccctttccattatcagagtgtttgcgttcaaagatgtaatcatatgggtcatcaatatccatacgctgccagaatacaccaagttgaatattgcctgggtcattaggtttagaacctgtgcaacgacctaagtcgcggcgggaatagcgatgatgaccattttcgtccatgatagtttcatagcctgtgcgtccacgaccttcaaggtctttgaattcaaccatcttcactttatcgccagacagagtttcataagtatatccagtttcaaagtaagatggatttccgtcttttgattgaaccataacaataacatcttcaatattctggtcatcattataagtgccaagatgccatactgcttgatattggttttcagcttttactgtcgctacacggaacttttcgtcccaaacaccattgacaaaacgtttgaatttgatttcataagtgattaatttgctcattataatttcctcagattaagcctaatgcacgtttttcttcagggttcaatttagataaagcgttctgttttactttttctaaacgagcaactcgttctgcttcagtttcggtacgaatttcaaaagcacttgttcttaagaaagaaagtttgcttccatcttcaagagtaagtgtcaaagctttgacaggctgacggtcaacagtaccatttgaaccataccaagatttaccagcgacactctcttcagctttaaagtaagagtcatagtaaccataaacttctgagcggcggtcgtctggcgaaattctggcgacatatacatcactttcttttacactgattactttcattgtacccactctccattttcgtcgatataattaatccagtttgaaatggtccaagaagaagtatttcctttaggagcatcaacaatatacattccgtttttaaataaaactcgctttacgtcattagaaattaaagaagccataatattttcctcaattggggctttcgccccgttgttgattatttcagcatagttacttcagcaatttcagtccagtttttctcgtcagtagcgacgaaatctgccaagtaaagagctgtgcggagagatacattacgaagacgattaacgttgttttgcataaatgccagaacgtcaagtacttggtagtgttttaatccgcggttctgcaacatgtcggttgtcataataacatcttcaacgcgagacatgatttcttcgtttgtgtgaaccccgaggtccagataaacagaacgagataccaaagcagaaagatgcggagctaatttgctgccacgttctaattctttatcaatatcaacgttagtgatgaatacgacagtaccttcaaattcaaattcattcggaatatctttttcttccaggaaagcagaagcagttgaccagcaaactttacgtttttcgccagaatcaagagcagctttcagaaggttcagaatgtccatatcagaaaatacatccacatcatcaataagcagaacagaatttgaatggcgagattcccaaagacgacagtaaagaccgataccagaaattttaccgttaaccattttgtattcaatatcaccacgttcgtctgctttagttaatgctttatccaaggagtaagtcttaccgatgccggcagcacctgagataatcagtgaacgaatgttcccgttaaccagaccagcagtcattaaccccataacgttgaagcgtttagcgatacgtgctttcatttcttcaacagattcggtcagaacttctttaacttcttgaccttcaattttgtaatcaccgtggaaaacccatactccgcgtttcttaccatcgatgtttacgaatactttaccatcaccctgagcagcgtcagattctgataaatcttttgggaaccactcgccgagaagttcgaaggtaccggaaatttctttaccgaagttagtacctttggtgatagtgatggttttcattttattctccgagtttctatttgtttggtatgaggtaatagtatcatcatctcataccgttgtaaacaatatttttaaactaattctaaaatttcgttgatgtagtaaggacgaactttagagtccaagaagaactcatcaacgaagtcaatcagttcgtcagtagtaccagagatgtttgctaatttagaaaaaacttccccgaccatcaaagcttcaaatttaacattgtactgacgagctacttcttcggcttttgcaacgttgtttactacgatttgtaaagttttcattttgttctcctttggttttgatagtgctataataccatatgctatagcacttgtaaacaatatttttaagcaacatatggagttgcagaaccatctgagtaacgcgcccatacttcgttgccgacgttgaaaagttttgctttacgaccgttaggcatctgaaccattttgcttttaaccggagttacagcttcaatcaaagttccagcagcttttgcattttctttagttttaagaattttttccatgtattcaacgtattcgatgatagcaggtgccatatgctgtttgtggcccataccgccaaaatcgaattcagttactgcgtagaaagtttttgaagtagccattttattatccttgatttttgttaccgtttagttgatagagatatagtatcaaaacttaaagcatctgtaaacactttttgaaaactttcttcaaaaacaacaaaacctcccgaaggaggttattttgaatgtttttctagctgacgttcagcaaacagctttggctgcattaacaaccaacttaagatacgccagatgacttgtatgacaccgacaggtagccataatataatactaaacaagtaattaaaaggtgtctctatgaaccctcgtttaacgagagcgtttgtgatgagccacccgacggctagataaaccaatacaataaagacgggcataatccaccatagttgagccaaaagtaaagtaaccataatcacctgtagtaagagttgtggttagccagataaacttcttccaagaacttgtcccagaacgtcatgtcaactttatcaggcataccgtttttagaagcgatgatgctttgacgttcaacttcatctacacagttttctaaccactcttgaacttctttgaacggaatagtgccggctttaactttcttgatgaactcagcatctttaagcggataaaccaaatcaccggttgtgtagatttcctggagctgaagaccaccacgaagagcatgagacagagctttccagtctacaccttcgttagcttctgctttacgagcacgttcgccatattcgttccacagtttagtgagactgtatttcatttcggcgacagtgattgttgtctggaatttacgaccaagcacgttgtagaacttctgaacgccagatttgtggtcaacaaaatcagtccactcaaggaactctgaagttggaagcagatgagcaatatcagcaactttccaacgaacattgtgagctttatcttttggacggtcttcgtatttccattctggataaggctctaatacttcaagaactttacgaagttcagctaaacgagaacctttgacaccatacttagctgcttgcttacgaacataaccaagataagctttcatatcggttgtgtagaaacgccaacggttatcttgaatgaatttccatacttcaggaagttcagacttaacaaccatatttgcaggagtatgaagcatgtcaagcgcgacagtttcacctgtagctgctaattgcaggaagtacttcaaagaatagagttcatggtcaacatcatcatgggagttctttgttgatgtgttgtttgtattcaagttggtgtgattcattgcacgaccaagaagaatttccttcggatgaggaacgaagatttctttgaagtccgtgtcactttctggtgttgacgtaccataaagatggctaccgaagtagcctttcataattgttttcatagataaatgtgttgtcctttggcaaattttactagctcattggtaattttaacacactgttcaacgtgttctttatcttcgcttttctttgaagttctattaatatttccaactttctgctgagaataatagtatttcacttcatgtgtatgatattcttggccatctggatgttgttcccgctgaacatgttcttttaaaacagtttcatagagtggaactaatgcccaatcacttccgatattaatgattgctacttgaatgtcaatcttattccacttaaaagcattaacatatccaaggaccctttgagaagggtccatcatagcaaattttattccggaaatagaagccattggcatttgttttagtaatgacatactaagttttttcttagtagttacaacttctatttcaatcatttagtcggttgaccccatgtgaattgaccaccgaaagccgcaatcaatgaagtgtcattcagattcactggcagaccatcaccgttttcagattcgaggaacattgtaccaccatttttagtgatagcaattacagtgaattctttagaacccttttggaagacatcaccaacaactaccggaatatttttaaaaccagaagcttccgcttcatatgtttctgtatatcggccgtcttttggtctgaaattagtgaaatcaaccaagtacttattacgaattgaagttacatacacattagtaacgccgtatgatgtaattttattttcatcataaatgaagagttcaatcattacacgagttgaatatacttttaaaacagctcgttgatttttattgattttaaggaaaatatgagttgctccttggcaacggctaataaaatcaatttcaccatcaaattctgttgttccggattgaacagtaattgagcgtccaacttcaagttctttctttacaatacctttagctttcacttgacgaataaacataatattttcctataagaagcgccatgagccattacgatatgcaactgaacggtccatcatttcggaagaggtagaacttccgctgagtttgtcatgaactactgtaattttgcgtccgtcagcaaaaataaattcggctactggacgcaggccagtaaagcctttgtccacagttgcattaaatttagcagattcaccgttgataatatagttctggtcttgtttaagcattatttaaattccaaagttgggcagaacttctctttgcgagctttaatgaaagcaataatgatattaggttgtggttcaacgtaagtaccatttctgatagcttcccattttttatcttctttcttttcttttcgtctttgaacgactcgataaattccgtaaccaatacagaaaattgtaccaaaaatagcggccagaataagccaaccaacaatcaacccaggaataattgctgcagcagaagacagaactacaccacacttagcaaacaaccatgtagctacatcaacaccagaaccccaaccagcgaagcacacagcgaatacagcaaatgccagaaggaatgtgtgccatacacctttccaaaaatatggacacagagaacgtggagcgctttcagcgccattcatagtaacgagtttgtagtgccaagagttagtattgatttgcattataatttcctttcaattcagttatttaaagtttttagaagtggtcatatgaggtattgtaacctgcaaccatgaaagcaatttctcagcttcttctttaagaagctcaacttcttcgccttgggaaataattgtgagaatatctttatcggcattaacgaagagcattgttttaatatcagcatgaccaccataaactgattcagctttatagttgatagtagcatctaaccctgggacgttccaatctaaagtgcacttagtcatttacttgttccttacgagctcgttctttaagttgctcttgaattttgagcattgtttctgtatattcttctgaattagctcttactatactagaagaatatggaagcgattcatgatatttcaaaaatctctcaagatgcggtttgtattgagtagagaaattgtacatcaaaaatcctgtagcacttacgtgagtacaaatttcatactgaaatgttccgtcatattgacgagtaacaataatatcttttaactcaagacttaggctcattgacttctcctgcataaagtttaagaatgaaaaacgctacctttaaagcctcttctttacttaaatgaagaggagagccggcataacatgctccttcagggacagcatgctccaaaacaatttcatcttctttagtgcgaatgtctaaacttcctagatgaaattgttcatatccccaagggtctttcattgcatctccttaatagcttttaagaagttatcaagattctctttactgcaaaaagatacgcagccatagcttccatcttttgcttcaaatgtaaatgaatcatcaccgtagtcagtgtaatcaatattaggacattgattacattcaatcagatgtgctttatctagacggaaatgaattttaaataaatcttcatcatctacgtggccaagtttacagaaatttccacgtacttcaagaactagaggaccatgtactgagccgctttcaaatgtatgtttcataatcacctcaattgcgaatcttttgaaccgcgtctgttgtaagacgctttaacgatagtgtcatgtgagctttgacaagccacacaccgggtgcatcctttttgagctttgcgtctagcttccggaatttctccgtcgcaatcttcgcaatatttttcactctcgcgattttgagatttgatgagctccaaacgagcccattcaattccatcacttactgtagcttcaatagctgcaaatccgtcgtcacttggaccccatccacttgccattacaaactcctttgaacgaggtccattataccattaaccaagttatatgtaaacaacggattgtggtattgaacaaacagataaagcagcacaaataccgttctcattaccagcctgccgtatcaaattcaccgtcatcatagatatcaccccaaccccaacccattcgttcttccagaactcggattggagtccaatggtcagcatattcctggtcttccggagaagagaatttatttgctttgagttctttcataaattctaaagcagattcaacatcaccaaacagacgattcaagttatgaggcttacgttcagcattttcaaatacagcgttatcaccagggcagatttgagtgcggtaagaccgcttcaattcaccgttgatgccagtgtattcacagatgatatcaaccattaaaatatctgaagttggactacgatatggcttactcagaatgatgtatttctcaacactatccaaagatacttcagtttcagtacgagatacaccatacacgtgatacatgatgcggcctggaacgaaatcagataatttagtaatacgattcatgatgttctcctcttgtttgtgtaaggtcatagtatcaccttttgaggaggatgtaaacggttcctttaaaacaacaaaagccctgaccaaaaaagtcagggctcaaattattccaaagacagcaagtatttggtttgaaacactataccattgatttcgtcaattgtgtttctgattgctccaggcatcttatcatagatgctttcagcttttgctgtgatgctatcgagcatctcaatagtgtcagtaggcaaatcctgttgcgatggtatagatggggtgtactttttaccggaccatccaagccattgctctccgaacttgtcggttaactcagggattgcatcaaagaagaaattgtatgctttgtgacgagcatagcttttagtttcaaaatgagctgagtggaagtatgatgcagaagccatcaaaagaccaatgaactcatcctctggaagtttctttccggttgttatgaaatcttcaaatttcgttttcaagtttaaccttcgttagagaaacatattgcttaccagcatgaactccttcttcagtgcactgggtagtacaacttgaagctgcccatttctgcttaatgaaagaaaagaaacgttcagattcttctttagaaggttctttgaacttgctatatactaccatagcaccatcagcgtattgttcaaagtttgcttcttctgccgatacgggcgagattaaagtggctgcaaataaaatcgcagccaatgcacgtagagtcataaaagcctcagcgttgtcctgtattaagtttgtgctgaagaacagccttaactttatcgaggtatttttgcagctggcgtttacgcaaatagtctgggcgtgcaccatgctggcgaaactcttcgtttagacttgagatagcgtggccaatctcgcacttaatttcttccagttgagatacaccaagattacgaagttgcttatcgttcaaatgcttcatacatacctcattagttagtaatagtatttataaaggggagcatgctccccaatttaactttagtcccacaaaatttggcacagacctttctcatacttacgagcagccttttcgtcccaattatagtccgtatcgtttctcaacgagtgtttgatttccatcttgtgaaatacacgaggaatcggtgaagcatagcgcatccagcgcagagtcttccagaatgaatcacgatggcgctttttcatcatagaagcaagctctaacggtctttccatgttttgtgcaatttgcttatcgatatattcattacgccaaagagaagttctctcgtagtcataatctttaatataagcaaatgggttattcttctggtcgtgccatttagaagaagtgattacgtgccagcctttacgacgaatagttcttgacatatctacctcttgagttaaagtacctcaatggtagtaaaatcctgctttaaaatatttcatggcgatacctttccttcgattaaaatctttaagaatccaagtaaagcagctataatgaacccggcagctggaaaggcgaataaccaaaataatacttcaatagtcatcctaatgttaccttacatttgcattttggacattcagcttcttttactcgaagacgcttagtctttgtgcgaggagcttcatcgtaatcataaacatgaagacaccgatagcagatgactaatttcatcggtcaattacctcgtagatttcatctatgatttcatcaccttgacgagcacgaattaactcttcaaatgtaacgggcttttcagaccagccaagaacaacagtgttacgttgtagcatatcacgaagttcttctaaagcttcttgtttagttgaaatcatagaaccttcttataacattcgaaattacctgaataatatgcttcagaaacgtaatcaccttcaacgagaagttgacaaactttatctgcgagcaatttgttcacttcgatttgttcactcatcatatatccttttacacccaagaaaacagaagccgctaaagtgataataagaagaactgtgttgaagatttttacactattcataaataccagtcatttcacaccaatgttttcgacagagtgagacgtatttgtcttcaccacctaattcaatagtatcaccttctacgatagcatttccttcttggtcaacccgtgctaccatagttgctttacgaccgcaatggcaaacacccttcagttcacagagtttatctgccgtagccagaagggccgcggagcctttaaataggttaccacggaaatccgtgcgaagtccataggccatcactggagtgttatagaggtcaacaatctgacataactgaagaacgtgagactgggtcaagaattgagcttcgtcaacaaacacacagtgaatatctttttgagtctgcgcccatttgaaaaactcaagaatgtccatgtcttcagtgatggtatttgcttcagcatgtagaccaacacgagatacaacttcatttgctgaatctcgcgtgtcaatagctggcttaagaatgagtgttcccattccacgctctttatagttatgagctgctgtaagcaaagatgctgatttaccagcgttcattgaagcatagttaaaataaagctgagccattacttaggttcctcaaattcaatccagtctggggtgttttggaaaattccttcacctacatggttttcacaacctttattagagcaataattccaatagtcccagtcgcaagccatttcatcattgcacaatgcaaatactactggccatttgcactttttacatcgtttatttttatagatgtaagtttgcattattcgccgtcccaatcaacaactacaatatcagtatttggagtaaacatattaattagtgcttcaatcttttcccaatcaccgccagcaataccggcaccaatacgaggaatgtagactttcaccttaaacagagaaccagataaaaatttatctaatctttgaaaagcattaactaacgcgccgtaatcaagattagggcctggctcatattgagtataaagattaaagcaagcacttccctttaatgcatatgctaaactaaaagttccaagcttttcacgggccgcataatcagtagctgctttatccgttgataaaataaccggaaattttgatgcaagttggcctgctacaccagcacccatggtgtgaaaacaattgcatccgtgagcaattactttgccttcggaaaatagcttaacaatatcacctttaatgtattttacaatcatcttttcctcaactcaggtatgcttttaaattgataagtagcgtagttttcaaattcatcgtaaactcgcacataaatttcttcgccgcatgttaaattcttaaaagacttcaaatctttttcagaaaaatctatcgatactccattgatggttccagaggatttggctccgcaacctcgaaaatgaattgaaccacccggaataatagcttggtcttctttgttagagaaattgtaaaatgatacaccaaaagctttctttttcggatagtaagaaacttcaatattctttttaaacgaaccagttgtttcaactagcttaccatcaatagcgtagatattatcaggatagcctgggagtttttcccaggcatttaccgataatggtagagctagcagaaatgctgctattttcacttagataatcccgctatatacaccctcaataatgtgtcacgatattcttcgcaaacattcatatcaggcgcattatcacacaacgactccaggtctttagccttacgagccaccaaggtagaccatttaaagcggctaccagaatcagtttgtccttcagcataagttttgtcaaagtcaaatgacaaaatgttcaaacactccgtattagtcttagtgcagaattgctttgctaatgccagtgaatcatcctgctcagtagcaaaatccatcttacacccagatagagcaaaaactattagaagtacaaacaaccttttcattattccaccgtataatgaagcattttacgagatttcaagtaattcgcctttgctaatacttcagaggcgtacttgttgccggctttccacttgtttcctgcgttgtatgacgctatggcttttctcatatcaccgttatgacggtccaaccaatagcttaactcaatgtacgcccaagcggcggagtgcttccggctctttgccatgcggatgatttcagcgtctgtcattgaccatccggcttgtttaactctttccctaagtgtaggaagataattttgaaatatcccgtaagcttgatgtccgtgtttaccagttgtacgtaagcctgcggaactttcctgccagactagtgcagccataatgtaaccaagtccatcattgtcatagcgcttactatggtctttatacttcccattcttctgaaattgttcaccaaacgaatatgcgtaatgcaaattgtcgagttggacattactgaaggtgtgttcggacgcgaatcctagagacgaaactaggagtaacgccgcgcatagagcttttttcatgtttacctcaaattaaagctataacttgataatctttgtgctgattttacctttcaagcgtttatcatttacaaatgccatgcgacactgcatggaatgaccacggaacggatgttctgggtttggtaaagaaacagtcattccaagccatagagtaccatctgtgatttccagacgttgaggtctgtactctacttctgggtcaatttccaatgggtcaattggaagcatcggcatttctaagaactcgtgaatttctgttacatgattgtgtactttgtggaacagagcgaacacatactcttcatcaatttctcgctggatagcacggtccaggaggtgattagaatatttaataaagaaagctggaataccagcagatgcacaagcattacgtatagaatcgtttacactcttgaactcagtctcaaagcgacgacgtagcttgtttcggcggatgaatacttctgggttagttgtcattttcaatctcctttgttgatagggctatagtatcatagcccttggagaaagtaaatagtcagtagttgtggtcatcgtagaacacttgaagcagaacattgctgcgcagcttcttggtgtccgcgatgcgttgacggagcttggagattttgtcctgaacaacattgaaagcatcagaagtcttagggtcatgaagacccatagactcatccacaagctgctccatcttttcttccatagcattgatagcttcggagaaagactcggagactttgttacgaattgacattaatacttttcttctggctggaagactgaacggcatgcccacatagaagcttctttcaaacgatcaattgcattacgaatctgagtgattctagaatgagctagatcgaattcttcgtcgcttatagtgtcaacatccaagtccatgtaaactttgacatgctcttcttctaaggctttgaaaatcaagccaagacgtaattcagcatctttgatagcgttcactttaccaattttgtcatcagtatgtggtttatagcctttgatatcttctattgacattacatttccttagtgaaagtgcgtgaaataacgtcacgctgttgctctggagttagagcattaaaacgaacggcatagccagaaacacgaatagttagctgaggatatttttctggatgttgaactgcatcttctaaagtttctttagacatcacgttcacgttcaaatgctgtccgccttcaactttaactgtaggcttggtttcaattccaatttcacgagattcaagaccaaagaaagtttctacatcaactatagaatcttctggtaaagttttagatacaatcacacgggctttatcaccatcttcaagataaattgtgcctttgtgagccccgttcaaaatttgatatgcgttcataatagttccttatggatattgaatttcttcgtcagtctctttatcatactcacgaattttgattggttcattaattccataaccacttatagtaagaccagttttagcatcttcccactgcattgttttatcgttccacacgccattagcatgtgcttccattaaatcttgttcgccttggtttgaaaaccagccgcagaaagattcaaccaagtggtcggggatgtcgataataatttgcgccatgttggctccaaagaaatgaccttgcggtcgtaagtaattaagcttgaagttttgatgcctttgcatgggccagagataaactctacttcaaaccacggatgctcattcatcagacccacatctggcgaagtgcagaggaacaatgagcctttaaaaggtccatctaaaaatcgatacagctttggctcaagaactgccccatctgaaaatttgatatgcagaatattaatcaaagattctacattacattttccagtagaacgcaaaaagcggatatattcaccaatggtcatatcaagggccaaaaggcccttattaaaattttctttcatcattgcattcctatcacaaagaataatggaatcatctcttcaccagtaacgtgtgattgatgaacacatgcataaaacggacctttgaaatgggcttcatagaatttttccatttcagggagtttcattggttcttctataatatacaagattctgttaagcgttcggccacgggcttttgagccaccgtcgcttaggaaacttcgcacagtgtccatgattatcatgcgtttggcttcttctggatttgcttgatgaatgagttctttctcataacaagctcttattcgttttgcggtttcttcagagtttcgttgatgagtgctaataatccagacagttccaccatcatgtaaccaatctgctgcaaattcagcaacagctttagttttacctgattggcgtccgccatcgatttttagcgtagcatattcgcgtagaatatctataggagtgtaatgactttctttgaggatttctatacaatcatcagcacggattttgaatgcgtgcatcagggatagatatggagcaaatagagatttcattttcatagagttacttaccgttagtgagggccttccgtggctcaagaatttccatcagctagcgggagtgctaggaccctgattgtaactggctttaccgcacttgggctcgaccttttcacaggtaccagaagctacttcactcagaggacacgacgttcatgaggagaggtccaggttggctttttgattgaggattaactaaatgggtcaaccaatttattgccttcacgacggaagactttagcagcaaatttattggttgggttatcaaccataattttgcgcatatgaccggttgctacagtacgggctgctttatatccagcgatattatccttgatagttacgcgcttaccgccgggaccatccgcagttactttccagacaccagtgtcatcaccaggtttgatattctcaatccagatgtaaccaccttggactcgcttttgttcagctgcttcatttaaaaattcattataggttttcatatgctttccatgttccaactcggaatgtttcaattactcgtttagcacgatttggtgtctgacgataccacttggaattagcaagctcttttgcagctgcttcccattgttttgatttaagcagacgcattgatgctgggaaaccagctacacctgcaacgcccatctggaaaaccatattaatgagtgcagcgcgacgaactccatcaagtacatcatatactggttttaatacagcatttccgagaatccctcgagttgctttatcgacatctttcgcaaaaatagcttctgcttcagcttttgtgatttgaccattacacggacgccccacaagcttatcaagttctcgtttagcaacatcaagagaagggtcacgagtcaaaaggtgaccgataccgattgtccaaaaaccttcagtatctttatagattttagaatcgtatccttcatcgatacgaagcatgccaaaaatgtccatgaggacctcctatcagttgataggagtatttatttagcattcccaaagagcatcttgaatgacctttggataaagtttttgcataactgagaataaacttggacccattactacattccacatacgcggatgaatcaaagcaaatgcatcgatttcagggaattcatttccgtcttcatctgtatgatatgctgtgcaaacacaatctctgaattgagagtgttccactggatgcatgtattggaaaagatgtatatctttattgctagcataatcatgacgacctaggtcaaccagtaaactctggtcgtaatcgacaaagccggtttcttcacggcattctcgaatagcagcttcaataggtgtttcaccttcttcaatatggccctttggaatatcccagcgtgatggcccaccgcctaatccagaattagtcactcttcccatgaatagttcgtagtcttcggtaaagaagataattcctgcagatacttctttaattttcttactcaaatttcaccccaactaatttcacgaagtctttgcatgattgactcaacttcttcaatcatatcttcgtcagaatcaaacgaaccttctaccatccaatcagaaattggagtgaacatttccaggcccgtggacagacgattacgaatatcatcaactgactcgttatcattgaaagagtacagataagaatcagccgattcagattttacgaatactgcaatactcataccttttcctctaagaagtcagacagtttaaaatctttgcggtccatcaaaccataatgaatgttcttcagcacgtcgtacatatcccaatatttctccttaagaatgttgccaaaaggagtaacatgaagcttatcccatttagcagctaactgtccgttgcgcatttctcctggaacattttcaacgatacgtaaaactttaaccgcaacttcataatcggatggaggaatccatccccaattatgatgtactgaaccgttaatttcgccattcagcgaagtaaaaatcgtagctggacaactcatcgtgtacctctaataccttgaataaagtttaaagcatcttcacctggtggaacttctttagacttagattttcgtttaaagagtttccactctttcttttggtcgaaggttccacgttgaacctgcccaagataaaataaccactttccaatccagtagaatggagttaaaatgccagccatccagccaacaaaaagtaattgttcaccatacaaaggactaaagaagtacaatccccaatatgttccaaacccataaagcattgtgaacataaagcaaataattattgtacaaacagcccatccaaaattatcatatgaaccagcatctttgaatccgcgaaataatgttttaatcatcgtttaatcctgcatctggagataaagttctctaaattttgtttgtcgtcgtaaatggccttggctttagtaaacaatttaacatgaattttacaataacaccacttaataaaagaagctaaaactattaccacgaatagtgaacataacgcgcttagtggtacagagataatcatttctgctacaaatccattgaaccaccaaactacgaaatttgatatgaagacagtaagtataataattgcccaacaaacgtcatcctcatatttcgacttgaatctatcggcaatttctcgttcaaaatgtctgatattcattttaggattgtatttcattttttacctcgacattccgcaatgaattcttctgattctcggattattctattacgaagaactttagcattctgttcagctaaacgtttattttctggtcgcatcacccaccaaattgcaatcttgggagctttattgtttgaccaaatcataaaaggtatagctataaaaatagatgtgacgaaccaaattggagcatatgggtcaggtaaaagaatagaaggaaagaaacacaatgccaccgtaattacagatgcagcaagacaaaccatcatatgccaaaagtctgctttttcttcaagttctcttaattcgcttcttggctgatatcccatgatcatttcctcgctttacggcagtcgttgataaatccttcaaatcgctcagctttgccaagctttgacactattctatttcttcgcatgccaattaaagtttgggcaatcacattgacaaattcgccaatcaacatgacgatgattgccaacattccccaaccaaaacatgtgaacgcagccattgctccagcagagtcagctctttcttcttttggaagatttgtgatatcagaccagcccaaaaacaaaataattgcgtatattgacaatcctatgacccagcagagcttttcatttctagtcaaaatatatctgacttttgttgaaagagaatctgtcttagcaattttagctttaagttcatttgaattcattttattttcctcatagggcccgaaggccctttattatttgaaaggacgaatcatatcaaagttttgtttaaagcgtttgacataatctgtctttccaagtttcttatgcattgcaactatcttatggtagttttcccatgcatactcacggaaccagccggatgtaatgctagtacaaactttttccaaagcgtacataaatgaacccgtagggtctgggttgaaattgtttggaatttgatgacgttctaaagcaagtacgcaagtttcttcatatacacctgcaagcttgagttcttcaggaagagaatcaaatttctcttttgaagtcattacttcagagccatctttcatgtagaaggtataagcaggacgcccagctaaggccactgcttcgtgaattgaatcgtggtcatagatgtaaaaatcatctttgaagaaagaatctttatctacatccagattaggatgagaatatgctaatgtctctttttggcgcagttcagaaatctttttcagtctactgtctaaaacaattcccttattacgcaagaaacgaatatgatgcatagtcttttggaagaaacgagtgttcttcttgaatcggtgagacattttaattgctaagcacatctcaggagttgcccaatacatctgtgaaagcgcatcatagcatccattaaatactgcgtaatgagcaagcagttcagatgaactctcgtcgttatattcaaaaatgtatgcttcaaaataagtctcacgaccgttgtgcatacatttgaaagctcgtacattaggagattgaacttcaacctctgtgccgttcatacggtttttgaaatgaagccattcgcctggagacgcaatgaagtcccaatcagagttcttaacatcactataatcaatgagaccatggtgatgtagtgctcgagaaccaataaccagcaacataatattttcctctttagactgtagaactactataacacacttgacttctgttgtaaacggttctttctacacattctgatgaagttttcaataggctcttctggtctattggctggatagcatttcttccagttccaaccgcctagtaagtcaaagatttggtcaggaagagaatcccatggatgctctctttcacgaagttgaagcacaatgtctccagccgcttctctaactccagtatcaagttttccattacaaattacagcgtccattagtactgcaagacaacaactatcatggcttccgtatttgttcggatagtagaaataatggtcaataatgtagcagcaattacggtctaaacctttcatagtgttcctccagtgattctggggaaacttttcagtctccccatattaccattaacagctgctagtgtaccacacagagccgtcctcgttaaccccaaaggtctcagagttaccttcgccgtaacagtcagaagactgccaatcattgaaagtcaaataaccaccagaaacttccataccaaaagaagcttcattcgccatagtttcaagcttaccaagaagtttagctacttcaactgctacttcttcaatttcttgacgtttttcttcacgagttttagacataatttaccttagcacatatcagaggaagaaagccaaacgccttctacgagtttttcattttcatcaacttctacaccatggtgacctacaagccagtgagcatcataaccaactggataataagtacgaccacttccgtaatcacctacatcaaaagtcaaacaatgctcatcagcaataacttcagcagcttgttcaatttcttctgatcgttctagcaattttgcaattgctgcggcagcagatttacggtcattatattcaggaatttcaatctgaatcactttattcatttcttgctctctttgcaatctgcccacggcagtagttaatgaaatcggaaacatctgctccgatatggcttccaggaatctggagtttttctacaagcttattcatttcagctgaaaagtgcttaacaagatattcccgtgaaggaccacggaaggcttgagcttcttcaagattattatcagcaataaatgagaaaataaactttccaccacgagtattgtaatgaacttcaatagctccgcagaaccaatgacccattgaataacgagttccttcgtcttctttacgaacttcagaagtcaagttattcaacgaaattgatgaataatgatacgaatatgcgcctttataagcgatactgcatccatcggcaattaaagcagaaagaatacgacgaacatctttcaggctgttgatgtaaacgtgacctggaacttttcgttctttaagttgatggtcatccatacgtaaagaataatcatcgtatggtggagtcagaggttcaatgatattgattaagcgctttggcataccagaatattctaattggccacgaacatatttcccaaacttatttccagtagaaacttttgtgtctccggaatctttcttctttggttcatgaaaatcatcataaaaagccataatgttctcctcttattatcccgaaaaccggggatttctccccggtgtatttcttagcctttcagactttccagatattcctggaggtcagcggtggtggtttcaataccgaccggagtggtgttgaaggtatcaatacgagacagggtagtctgtacatcaactttcatcagagatgcagattcgatgatatctgctacgttgtccagacccatggagttggcggcacgagtttcacggatgtactcgagtttcaccttaaggtcttcacgctggtcgtccagagctacgacagtagtttcaatttcagtaagcatctgtttcagttcagctgctttgttacgcagagcttctgcagtacgacgatacagaagaccgagtttagcgtgggtctgtacgtcagcgttaggattttcagccagaattcggcgaatttctttttctttactttcagcctgtgcatctttttctgcggcagctttagttttgtcattgatttcgcgagtagcggttacatgacgagttttcagtttatgaacttcagagataatctgctcagcagcatgtgtcatctggtcttcgaccgaagtgttcttggtcatgaaggtgcccagtttgatacggatgaattcaacaattttcttcagaatagccatgtttatttcccttttgtttagagatttgaattttatactctgtattgtaaagcattgaattttattctccgattcaattttgttttgatgaggtaataatatcatactacctcaccattgtaaacaattttatttcattttgttgaaatatttttcagctgcttcgtcgtctttatggtaggtcttggtcaaagctaccgggcgaacgttgaaagtgttaagagaatcgcgagcaatcacaatagtaaaccaacgaccatcatcattacctaaagcagcataacgataagtgtcccatacgaattgcttaatgcttttgatatcattcaaagaatttgctaaatctgaatgaccgttcttagcaagtttttctgtgatgatgttgaacattttctttactccgtttgtttttgatggagttataataacacatctagaaccaatgtaaacggcaagtgaaaaaatttttaaagatagatttggattcaccagaacggttgagaggaactttctagatgggaatgattaaaccattgactacatatacaaaaatgccctgagtgtcatagagatacccagggcattaaatcttacttagcttctttcttttgaagaactttcgcacgttctactacgcggtgagctgtagccatataatcacgaacttcttttctaagagatgaagtataagcggctgtttctactgaagtgtacaaatccattaactcaggcgtgtcaatgttgctgatgttgcggcctcgacggattttagaaaactgagttttgagaacagcaccttcttttgcgatttcgtctaaaagagctaaaattttctcatacttactcacaattcctttgacattaaagtcatacagacctttgtcgaccttaggagctggagctgctttttgtgtttgtaccggagcaacaggcttaactaccggcgtaactttaggtgcaggagctgctttagcttcttttggtgctttagcaggagatttaattcctcttaaagagttgaaagcattttgcactttataatattctttctgttttgtagtgtcgatgccataaagttttttcactacagcagcaaatttcatgaagtcgttgcgctctcctggcggaactaaatccatagcactctgccatttcattttagtcatacgttcgccagcttcggtaatcatgtcagagtctgactctgcaataaattgtttaaaattaagcataatagtgttccatgttggtttattattgtatttatatgcaacaacgccccgtccgaagacagggcgtaagaatcgacagcaccacctactggcagatggcctgcagaagttcgttcccagcgactcggaggcatcagtctcgccctgggaatatagcgtcatggaggttatgcttgcgacagggaacaaccgactagcggcaatggaaaaaccattctcttctaacatgacgtctcaactaagggtatacgcaagtttccctttgaatttggtgccggttaacggattcgaaccgctgaccctctcattacaaatgagctgctctaccaactgagctaaaccggcttggtgcatcaagtgggattcgaacccacaatcctttcggcgggagattttaagtctcctgtgtataccagttccaccattgatgcgaaatttggagctaggagtgagattcgaactcacgaagggatacccggcggatttgcaatccgctgcctttggccactcagcaaccctagcaaattggtcgaggtagagggattcgaacccgtcgacctgtggattagaagtccactgctctatccagctgagctataccccgagtgtgttcagacaggactcgaacctgtaagcatgttcttgcggcgttttaccaccgtcgtcagcatatgattcaatatgcgaactcaaaaggtgttggaccccttgtctaccaattccagcactgaacaactttatttattacatatcaacttgagtaaaccagttgattttgaaatactcatcaaaatgaagagcaggttcaacttgagtatcttcctcaagaagaattaaattctttcttacaatcgggtcaagatgagttgtgtttaagcagctatcatgccaatatgtaagaactcgatttgattcagtatcaacgagataacgaacattcatatcaggatgtcggtacagattaatcataatctatttctcttgaagcattttgcgtaaacgatagagctgattacaaaattccttttcagtcaaaactgtttcagagattttcttcttgcccatactatgagttaatgttgcgttacgagtagcaatcaatgctttttggaatccagtgttttgagcaagtgcgtcataagctccagttaaaagattctggtatgcttcagatgctcgatgaataggaacacccttccagtaaagcgtttgagtaggccaccaacgtttcttcttgcctttaaactttgctgcctttccaaccaaggtgcaaacatgagcttgtatttcagggttagaaaatttgagggattgtaaaaatccctccattgaagcgcattctacaccgtcataaacgaaagcatgtggtgcaaagttacttaaagcacaagaaggatatgaacttccagagccaatgtccatttaattaccgtgagatattctagaaggtttcttatcaaaataatattcatacgagccatctaaacgacctgctttagtacggcaatatgaatcccatttcttataatgccgccattcatcattatatcttggatgacggtcagcgattaaaatctctaatggccaaccaggcgcaaaggaacggagccgttcgacctttttaatgtatcttttctttaagattttcttcatatagattccgacattacgtgagtagttctctttctgattgtaaattgagttaattcatcaacttcaccacaacgccaagcatcatcttcagtttcaaaaccaagagcctcaaataggtcacctagacgccaaccttcgtcaaactcggggtctcctgaaaaatagtaatagtaatcgccagttactaaatcttgaattacaaaatcaaacttttccattagatagtcaccgtagtaataggttcaggagctttaggaataacgatatcttcttcgatgtagaagagcttaaatgtttcagctacacgcatgaagtcaatatcataaccgactggagttccaatcaattcttgaatcttatccatcactttatactggacttgataaaaatcttcaagacgagcatcgaattcatcttcagtataatcaccttctgggattacaaagccaagcacttctgaacagaactctggagtgatttcttcattttcaacacagtattcaaagaaagcatcaccggaataatcttcattacccattccattagggtctgaattatcagatgcaaaacatttagcaacagcacaccaacctggaatgtgtctagcgcttacattgtaaatcatgttttcttggtattcatcactgtcattttcccatgatacacatgatactgcataacctttagggatagtttgaccaaagcggagttccataatatttccttcaattaaatggtggaagtggtttcatatacaaatctatcaacattctccatttagcaattactttagaatatggagcttcatgatagaattgcgaaatgccagaataatcgagtttaggtaatggagttaaatgaaccatgagttcacgtggaaatcgatgaaaacaattcatcatatctttgtaaacataatcaagtaagtctttaacatcaaagaattgggtatttagtccttctttggaataacgatatttcagaaatttccaatggccagacttagaatcttgagtaaacgcgtaatcactatgaagcatgatatcgcgaacaaaatcttcagaaaagaagatggagtgagtgcaaccataataaatcataatattttcctcagaatttggtgaccccagcaggactcgaacctgcaacctagcgattatgagtcgcgtgctctaaccaattgagctatagggccaaagtcctcctaagaggaccgagggtattattcaaccatgaaatctgctacttcatcaaagtcgttattgataacaacagtaaatggcagtgcttcatcgcttgttttgatagtcagcttaacgaagccatcaacagtttcaaccaaaccaacgattttatcagaacgtactacagcacgagctacatcaacaattttaccagtcattgcaaatgtagcgatttggttaacttcaacaacgatacgtttcattctttttccttagtggttttgataaggtaattatatactgaatttttaaagcgttttcactaaaaagccccgtaacagatttctctgtccggggcgtcatttggtgggaagtgttggaatcgaaccaacctctcatgctcttcaggcacgcgctaatccatctcagctaacttcccaattggtcggtgcggcaggatttgaacctgcgaccccttggtcccaaaccaagtgctctaccaaactgagctacacaccgttaatttggagcatccagagagaatcgaactctcctccgttgggtggaaaccaactataatagccgctatacgatggatgcatttgtacggaacgccaggattcgaacctggttacaaagtagttgacgctacattgcatttttcaaaggccgtcatctttctatgtcaaaggagcagcgtcaactactttatccttagacacatcagataagtcctcgaaccgattgtttggcaggccccgtaggaatcgaacccacgtcactaaggttggagctcagggtaataccactatacgagagacctaaaatggaggaagcggtgggattcgaacccacggaccgtatcactacggcctccggttttcaagaccggtgtaataagccgctctaccacgcttccaaattggggtggccgacgaggattgaactcgtgacattcgggatcacaacccgaggttctaccaactgaactacggccacatcaatatttactccagcaatcatgatgccttcacacgaaattgagagaagagtgatcagttcaacccttgtagacgcgtcaagtaaatattgatgtgacaataattggctggggtacctggactcgaaccagggaatcgtagaatcaaaatctactgccttaccaacttggctataccccaattatttggaggcgggtgatggactcgaaccatcgcgtaacgggatatgaacccgtcattctaccaactgaagttaacccgcatctatccggattcttgaagtacaaacaagtagctcgatgtagaacacagcatgctgtgggaacaacttacttcgtcctcggcatttacttataggactcaaacttatcttcaagaactgcctcgtatttggcggacctaacgggattcgaacccgtgactctcgcgtgacaggcgagtattttcaccgctgaaactataggtccaaatttactttcgtgagtatgggattaccctcaagccttccggaaagctgaataggcgttattggctctcatatacccgtgcacagatataatcttcattaacacaataacttcatcaatatactccgaaagtaaactttcggcgccgtatttaatttgagctatgtagttatcgttgagggaactcatagtcagggattaaagtgccgacgactttatcagaacgtcttccaacttctatatttggcgggccgtgcaggtatcgaacctgcctagtcatttctgacacggattaacagtccgtcgcttaccctctcagccaacgaccctgaatttggttctccgtaagagaattgaactcttctttccgacgtgaaaggccggcgtcctaaccgatagacgaacggagattggtaggacgtgagggagttgaacccatcgacattccgattaaaagtcggatgctctaaccaactgagctaacgtcctgtagatatttataatatcaaaaatatctttaagcaaattggtgggaataaccgggctcgaaccagtgacctgccgcttatcgggcggctgctctacctactgagctatattcccttggtggggagtgatggagtcgaaccacccgagtcgcaatgacaacagatttacagtctgcaccgctacctctacggaattaactccccgaaatttatttaagaactgttgagttcattgacttaaccaagaaaacttggtgcggcgaacgaagtgaaccttcaacagtgcgatgttctggaaaattggttgaagtctgaaaaccagctatacgataaccttgttcagtccatcctaaaaggatgccaaccatacacccggcagtttttccacctttatcgaaggctacaatatcaccaggagcaatttcattacccattgagtcaggcttaatccattgtggagtaaccagttctataggtatatttataccgcttgaagagtggtagtattcgtctgaacgaatacctttgatatcattaaacagtttgttccaggtgttgctgatactcataatgttctctcgcagtgttttggtgaatcaacgataattcatcgaagattgacttcattgcatttttcacaaaaattttttcagaaggctccatcgacgtattgttgatgattctcgccattcgttctttgagcttctttttccgattccggaccgtctccttggaagcagtcctcatgtgagcaagattagtcatcatgttccgtcgatagattaataatatcaagtagctctttaagcatttaaccgcgtttgtatgcgtgatgagccaaaatagcaactacagcaatagacagtattacacttttgattgcagttaaaacacaaccagtagcaacaccaataagaatccagtcaaacttattcattggagtgtctgcgtcataagttttcttaacccatgctttagctttggtgaacagttctttaatttggttcatttgcaattttatccataacgaatgaaatgataccagcaacgagtgtaagtactacgctactgatgagttcagaatttgaaaggaacggccatccgaagattgaagttccaagtgctcccagggttactacagtaaagatgtttccgatgatttcgcaacgtttcatttttaatctccttgtgttgatagggctatagtatcatagccctcaaggaaagtaaacggctaaaactattttattccgcgcgatgcaattgtgttctgtcgtttaacaccagtttgtttaaagtcatgattgtcgatttgatcagtacgagcaacgccaaatgatgatttgatcttagctttagagcctttagttatagaaacaaacatctcagaagagcctttcttaaagtccgaggcggatacttcaacgccgttcttagcaagtgacttcagaattgcctctgcatactcatcatcaagacttgcttgagtattaatgacgaatgtctttggcgcagtagcttcgttgataaattcttgataggttttcatttaaggtcttctgcccaatctagtttaagtggttctttgtattcacggtccagtacaactggtatctgaacttcacccttgaatgataaaggacctacgttataagacaacgtaatgtgaggagtgtagtcaggaaaatcatgcgttgcacctaatgcacgagcataacgatgtcgatgcttaagatattcagaatctagcaccaacacaagtactggtgattctccatggtcccaaacctcaagatgtcctttacgagcgacctcaaagctacctgacgagcatgtataaggtacatttactcttgaatagcaaatcgttgagtgaattttgtgtctaggaactggattaggaaccttcaactctcgctgaaggctctcaatagcatccaatgttaaatcggagaatttagctgcaacgtataatccagaaccgaggtcctggaaattaatcattcaacttcatcaagttcaagctgttctggaaccaaagcacgaactgcttcaacaaccgctttgatttctactgaaccattttcatcgccggtaacaccaacgagtttaatgatttcctggaagccagcagacagattctgaataactgcttgagcctgtgaaatttcttcgtttgcgtcaaacagacgagatttcagtgcagttacagtgccttccagtttttggatttgttcgctcatttaattaccttttcaattttagaatagaggtcctctaaagaaccatcgtttgttattacaatatcaccgtctctgattggtaaaccagcttcagtgatgtgagtatcttgtgaactttcactatctggacgaactacatgaattactatagcacccatcgcccgagcagcatcgagttcatggtcctgacgagtatctggaacaatgtaaaaatccaggtcgtcatggaagctatcgacataatcaatagcgaataacttcaaccaatacatgcggtcaaccatgttgcagaaaatatcagtcccaagggtctgcatgagacgacgtactgtccatggtttggtatttttatttattagggcttcaatcttggtatttccactgaatgaaaaatcaccattgtcatgaatgaagaacccgttttctctttttccagcttttaatttgcggtccaaaagacgataaacacaccgtttcatgtaatcgatgacgtctttgttattcagcaacagaatctgttcgcggtcataacctttaccttcaaaatcaaggcggttcaaagatacaccagttttttgggtcaaatctggattccagcaatcagctaatgtatctttaattggaccagcaagctggaactttttagttttgtagttattcgcaagatagtcagcggtggtgtctttacctgaccgtttcttacctatgatgaaaataagtttcatattacctcatagaaggatgcattgcaacagatgaacgagactgagcagcctgttcgatattttgtttacctactatgattttaccatctttttctatttgcaaatacttgaatgggaacatcgcagtgcaaataaccgccgggtcagcatcttcagtatagctgaattctacttcacctaaatcagaacaccaagctccataataatgaaaactcattacaattttcttcttggagttatcaagcatatgaacagaaacatgtggtggagtgaagccaggtttccacgcttgagagttaaaatcaatgtagttgttgattgaaagcatccattgatacatctgaagccaagagtttaggtcttcatcgactaaaaagcgtatgaccagtgggtcatgctcaaaagttgagcctggcagttgagaacgtgctagaccaccttgtccagatggagtttcagtgatagggatgcgtatacctggtatattagctgattgcacgttaagcgtaaaagcttttgtcaatccagcatcaggaatatctactataaagttagtaatattcgtttggttaaaaagttgattggcgtccaattcgctttccttctgaagtagttataatggttttgagttcttccggagcaatcaatatcaatcaatccggaagaagatggattaagatttccaaacagcagtagcagaataacgtttgccttttgacatgaactgttgagttggtaacataacaacgttagcccagtctgctggcttaatttctactaaacttcctttgatatgaccaggaagataagctttaatcatcttatccgcgccagcgaaacccttaacttgactccaattaatcttcaacttagttttgttagtaatagtcggagtgttagcatattgctttagcaactcttcgagaaactgttgtcgtgcttttggtggaatatagtgcaagttcaagccatacatcaacgtagttgagccttgtttacccaatcccaaataaataatcaatggaaatctatcccagaatggaagtgtgtctttatgtttagcatcatacatataagcataaagttttcctggagtaggttttgatacctgatgaccacgaatatttttcttcattgtctcgttgaaccaacgagctgacttattgttaacagctgcgccttcgttagcaatcttttgacgaatgctctgacggaaactgttaatcatcacaagttgtctttcttgacgagtaagtttctttggattctttccttcgagtttagcaacttgaacagctgtcttaattctcgaagaatatctgctcatagcttttgtgaatgtagcatattttatgcctttttcttcggcaaaagatttggcggtggcacctttctttttcgcttcagcatattctacacctatctctacccattttctttcgtctttagggactgttcgagctatcggttgagcaccttcattaagcaattcaaatatagccattagcctttccaccctaatctcttcagaccatcttctgtaagcaatctgaattttatgttattcttttcagcaactttttgagcagctgaccatttatcctggttcacactccacgtgtatatctcgtcgatatatcttttctttgctgctgtagtaagtttagcaggctttggaggtggttgagtctctttctttggcttaacttcaacaaagaattcttgtccgtttacatctctgaaccagaagtccatgaagtatctacgttttttaccttccgcgttgcagaaataaggaataacaacttcttcactgttccatttaactatttctggatttgcatcaagccatttcatgaaccatgactcccaggacgagcgatatgtaattttacgaatatcacccctgtacttttcatggttcttaggcatgaactttccgctgtaagccatttggattctccttgcatctgtcgaagtgccaagatttcattccggttagtttaccggttttaccacaccatggacaagtcattgtgatatttattttagctatactttttgactgtttagatttggtatcttcacttaaaacttttcctaagtgagtttgtcttatcttttcttttccttctggagtggtgaaagatttaccttttaatttttctgacaaagcagctctgtgtttagctgattttggtttacccttcgaagctaaactcattttacgccgagtttcttttgaatgagttttaccagtcattccagtatgtaattcagcattctttcttttaatccactcaaactctttattgttccttatttggccattcgatgaagctgtcattaatctacaagctttggccaaaccgtggtttgatggattcattttgagtaaaagctgatgagctacaaaatgttctgcggcagttagataaactaaattatctttatcgtctgaaccacccatgcatcttggaataatatgatgcaactctttatagcaattcaaatttcggtcttttgctctatccatcaaagagttgtaatgtctttgatagtccatttcattttcctctaataaataatattactatttataaagtggaggctttatgttattcagcttttttgaccctattacatacaccgctaaaacggttgatgaaaacgctaagcctatttccatgacagacattttcagaaactataaagcatacttcaaaagagttgctgctaactatcgtctgcgcacatattatatccaaggttctccacgacctgaagagttgtctaacatcatttatggcaaccctcaattgtattgggtacttctgatgtgtaatgataactatgacccttactatggttggattacaagccaagaagcggcttatagagcttctgaacagagatatgaaaatgctggtggaaatcaggtgttgtaccatgttgatgctaaaggagaaagatactataacttagtagaatctgaaactaatccaggcacatggtatgacaaaggagatactcttcaagaacatcctcaatatcaaggtgctttagcagctgtagatgtttatgaagcagctattcttgaaaatgaaaagaaacgtcaaatcaaaattatttctcctgctgatattgacacttttattgcagacttaatccgtgagatggagattgcataatggaaatgattagtaactctcttcaatggttcacaggggttgttgaagatagaatggacccgcttaagcgtggtcgcgtacgcgtaagagtgcatgggcttcatccattccagaagactcaaggcccagtaatgggtgttccaactgaagaccttccatggatgagtccaatatttcctgtaacatctgcagctatttctggtgttggtggttcagttactggccccgttgaagggactcatgtgtatggtcattttttagacaaatacagacaaaacggaattattcttggaacgtatgctgctaacgcaactgctcgtccaaatagaactgaaggattctctgacccgactggacaatatcctcgatatcttggtaatgacactaacgcattgaaccaaggcggaaccgaaggcgatgattatacagcaaacatagttcaagataataaccttgacaccggtattaatccagatgataccgaccttgctaatatcccagaagataataatcctaactatacgattgaagacatgattcgtcgtgacgaaggtcttcgtttgaaagtttaccgtgatttaaacgggcgcgggtggacagtagggttcggtcactatattagtgataacccaaatttaactaacgaccaaataaattccgaattatctaaacaggttgggagagaagtaactggaaatccaggctctatttcaatggatgaagcttcaaaattgtttaaagaagatttagaaaaagttcaaagagacatgagaaataatgcagctgtttctccagtctatatgaaagtgaacagatctcgtcaaatggctcttgaaaatatgagttttcagatgggcataggcggattagctaaattcacaaaaatgctagatgctatgctaataggcgattggaaaactgcttataatgaagcaagaaattctcgctggttccagcaaactaaaggacgagcatctcgtgtttcaatgattatattgactggtaacttagagtcatatggtatacctgtttctataccgagtgcaaaaagtctttcagctgcagcagttgcaatggcggttggttcagatgacccgtggggaccaccaattcctcaaacaggaagaatcttatttaaagagccagagtcttcatacaatggtcaatatccttatgttcacacaatggaaacagaatctggacatattcaagaatttgacgatactccaggatacgaacgttatcgcattcttcatccaactggaacatatgaagaagttgctcctgatggacgaagaacaagaaaaactgtcggtgatttatttgatatcacaaatgctgatggcaatattttaatttcaggcgataagaaagtcaacgttggtggtgatgaaacttattacaacatggctaataagacaacccaaatcgatggaagcaatactctctttattcgcggtgatgaaactaaaactattgaaggcgatggaactctttatgtgaagggtaatatcaaaattgtggttgatggaaacgctgatattcttgtgaaaggcgatgctaaaacacaagtcgaaggtaaccatgactacaccgtcaatggtaatgtcacttggtctgttaaaggtaacgtgtcaatgaatgtcaccggaaactgggctgaaactatgcagacgatgagttctaaagcatctggtcagtacactgtcgacggttcacgtatcgatatcggttgaggtaataatggttgacatacttccagtaaacactgaactgcctgatattcaagaaggcggttcagttaatcaaacattcacagctcaattagaagcaacagacacattagagtctataaatataattgattttcaacctactcctgggattatggtctcaggagccaattacaaaggcgtatatgaaagtgtcttttcctttggaggagatgctcttaaatatcgagaaggtgatgaatttaaagtagcacaatcgtgggaatctttaccaccttctggtacagccgatttatacctctggaaagccccctctaaacttgagaggacatttacgtacacagttaaggttatatattggagacaaggcgaagacactacaggaccatctggtgaacctgtcacacctcctccagttaaaatggaaatgaccaaaacttattctcagttagtgtatggtaattggagcaaatgggctgaacaacttcgctcatacgtatatgcgagaccataaatggccggattaagttatgacaaagctttaactgcaggccactctgcttatcctccaacgcaagtaaatgcgacacagggaaaagtatttgttggtggaattgcagttctagtagatggagaccaaataactcctcatactaaaacagttaaaccctacgacactcacgggggttctgttcaacctcgtacaagtaaagtgttcgttacaggaaagaaagccgttcaaatggctgaccctatttcttgcggtgacactgtagccgaatcgagtaacaaagtattcattcacggataaaacaatggcaactactgaaccctttaactatcaattaaaaagaaccgcgaatgcgattcctgaagttttcatcggcggcacgttccaagaaattaaaaagaacttcgttgactggctgcgtggccaaaatgagtttttagattatgatttcgaaggttcacgcatgaacgtactgctggacctcttagcatacaacactctttacattcagcaattcggtaatagtgcagtgtatgaatcattcatgcgtactgccaacctcagaagctcagttgttcaagcagctcaagataatggatatcttccatcttctcgttcggcagctaaaacacaaatcatgctggaatgtactcatgcattgaatgaaaacagtttaagaattcctcgcggaacaagattccttgcatacgctcgagacacaagcgctgacccgtatccattcgtaactactgaagacgtaattgcgttaaaagaccaaaacaacttatatttccctcgtgttaaattagcacaaggccgtattgttcgcactgaattaaaatacaataagttgaaaccaattatcatcagggacgaaaatatcgaccgttcagaggttcgtttgttcgttgacggtgcagaatggactaactggacttacaagtcaatggtgcacgctggttctacatcaacaatttattacatgcgcgaaactgtagatggccacactgaattcttctttggagaaggtgagcaatctgtttccgtcgctggcgcagctttagaagctaactacatcggcgggttaaaacctattcaagaccaaactatcgttattgaatatattcgtactgatggtgaacgagcaaacggtgctactgaattttcttatgctgatacactcccgtatataagtgtacagaaaatctacgaaaacccagatgattctccagattacgttggtgctgatggtggtggtgaccctgaagatattgaacgtattcgcgaactcggaactattaaaagagaagctcaagctcgttgcgtaaccgcaactgactatgatactttcgtttcagagcgtttcggttcaatagttcaagctgtacagacatttactgatcaatataagcctggctatgcatttattgcaattaaaccaaaatctggactgtacttaacttctgttcaaagagaagacattcagaactatctgaagccatttaacttggctacgattactccatctgttatttctccgaactatttgttcttgaagcataaaattaaagttacttatgctttaaacaaacttcaagaatcagagcagtggttacatggacaaatcatcgataaaattgatgagtattacaccaatgaagttgaaattttcaatgctcaatttgctaagtcaagaatgttgacttatgttgacagagcagaccattcaattatcggttcatctgccgaaattgaaatgattcgtgaagttcaaaacttctttgaaactccatcttcaggtattaaatactataaccagattactccacgcagtttaaaatcaagcgaattcaaattcattaaaggctcttcatcttacatggtacgtttagctggtactgtcggtgatggcaaaaaaggtaaaattgttcttgggccatttaaagtcggagatttagcagctactccagccgctccaatttataccggtagtgattttgaaaagcttccagtaactgatggaagaaatacatatttcgttgttggtgaagtagattatccatctgattatatctattggaatatcgcagctcttaatattaactcaagtttatttgacgttcaatcaattgagctttattcttcaccaaaagaaaacaacattttcactaaagatggttcattgattgtatttgagaatgatcttcgtcctcaatacacgaccatcacattggagcctattgcacaatgactgtaaaagcaccttctgttacaagtctcagaataacaaaactatctgcaaaccaagttcaaattaagtgggatgacgttggtgctaacttcttctattttgttgaacttgcagagactcgtaaccaaaacggggagattatactccccgaaaattatcaatggagaaatttaggctatactgctgaaaatgaatttttcgaagacaactacattcgcccattgagttattatgttatgcgagtggctgtggccgctgaaggattcgagcaatcaaattggaaaatgactgaagaatttcagtcattcgaaacgaacgtctatacgtttgaaatgatgcgtcagatgactttatctaagcagttcattgaagaaaaattcactaaagataacgaagattttgtgaattttaaccgtgatactatcatggcatctttgatggatgaaacattccaattttctcctgaatatcgcacggcttcttctgttaacaattttattcttaaagaagatgaataccatgaaattcaaggcgacatagctaaaatctgtaaagataaagagcgtgtaatgcttatggaatctgaaggggttctttatctctttgaaagattccagaatatcgttaaagtatcaaacgataaaggacagacttggaaggccgtacgattactcaatgatcgcgtagggaacccagtatcaaaaaatgtatattaccaaacgcggaacactacgtatctcctgggatacgacagggtcttctacggacgtaagagtaatgacattcgttggtcagctgatgacgtaaaattcagttctcaagacgttacgtttgctaaaattggtgaccagcttaaactaggatttgatgtagaaatttttggtacttatgctcggcttccattagcagttcagaaatatgctgaagctatcacagcaacagatagtatgatttatgttgctggtcgtgatgttgtttacagagctaagactagaaatgctcctatcgaccaagacccattatcacctacgtttggtgaaaaactgttcgataattggacttcaagaatcactggtaattcaaaagcagtttgtcataacttagtttccgtagatggtgtaactttagcattaatcactggtgaagttagaaacgaattagacgatcgtactattccagataatgttatcgattcagaatctaaaggtgtttatcttttagaaggggataactgggtaagagtctttggaaacaccgcagaagaacgtagacgtatagagcatggttatacttcaatgtctactaatggaacagatattttcttcagttcaagtaactttaagtttctggactctaatgtggtaccagacccagaaacaactgcaaaatatggtcttttaggcgctgttaagtatgagttcacaagagaatggttgtctgacaaacattatcatatgatgagtttcagaaccaattctaagagcggatttaaaacttttgttccaggcgcgatgaattactacgctgaaccattctttaattggtctcgtaaatcaaaaactcgttgctggattgacacatcatacagaattgcggttgtttattctgatatcactcactctaaagtcattgatattaatggctcgggttctcctgaccgagtgttgcatgaatactgggataaagggacttgtacagtaacaagtcctaacattcagtttgacaatttcacaaaatatgcttctggtattttattccacaaaatgtcaggtgaaatcatttcatacttcgaatttgattatcgagttcgtgatgaagtgtctatcatatggaaaccatctgaaattttcttaaaagcatatcttcagaaccaagaaagagttgttccttggactccagacaatcgtgacggacttaaagaccctgatttgcgtccattactgaatacaatgatgccagatagctatttgttagaagaaagcaactttgaggctttctgcgaagcttatattcagtacctgtcagatgggtatggaactcagtacaacaatttgctgaatttaattcgtaacaaatatcctcgtgaaaaagacgcttgggaatatttgtggtctgaagtttataagcgcaatatctatttgaatccagataaacgagatgctgtctcaagattctttgaagctcgtaagtctgatttttattcaactaaaggtattgaagcttcttatcaattcttgttcaaattgttatacaatgaaaacgttgaaattgaaattgaatcaaatcctggaacagaatacgatattatcattgaatctgattcagtgaacgacgatttagttggtcatacaatttatacagcgaccgggcgtacaaacgttacttatgttgaacgccactataatgaaggtcgtttgcaatggcgaattacaattcacaaccttctaggtcgtttaattgtaggacaagagcttaaagcagaacgtatgcctggatttagtggtactattgttcagggtgtacgtggtaaagagttagttgaaaataccatagagtatatcaaccgtaaccgttcttactatgtgatgaaaattaaatcaaatcttcctacgtcaagatacagaaatgatgttttaagatttgttcatccagtcggttttggatttattggtatcacgttattgactatgttcattaacgttggtttgacccttaaacacgttcaaactataatcaataaatacaaaaactacaaatgggatgcaggacttccacttatttggcctgaccgagtagctcaattagattcaaatggaaatatcgagcataacgatgttactggagaggctctttatttacctcatccaagagcaaacgaagactttgatattcctgacgactatgatgctgaaaacaataactcagtaatagctggtcagcttccatcggaaagacgaaaaccaatgagccctacattcgaccaaagtgcagtaacattctccaattggagagatttggttaattcaagacttattgataaagttaatatccctcgtgacccggctaatccaacacaggttaagattaatgaatgattcaagcgtaatctatcgttccatagtgacttcaaaattccgtactgaaaagatgttgaatttttatgagtcaattggtgatggcgataatcaaaacacaatttacatcacattcggacgaagtgaaccttggtcagataacgaatcggaggtggggttcgccccaccatatccagtagataatacacaaggtgttgaagatatgtggactcatatgatgggttcagtaaaagtaatgccttctatgctggacgcaattattccccgtaaagattggggagatattcgttatcctaacccaagaaacttttcaattggtgaaattgttgttgtaaacagtgctccatataacgccacagaagtaggtagtggctggttggtatatcgttgtattgatattcctgatgcaggcacatgctcaattaatactatcaaaaataaagaagagtgtattaagcttggtggtaaatggacttcttccgttcaatcagcatttcctccaagagggcgtggtgatgcaataaacgataataagattgatatgaaagacggatatctgtgggaatatctttatgagattccacctgatgtttctattaaccgttgcacaaacgaatatattgtcgttccttggcctgatgaagttaaagaagacccagaacgttggggttacaacaataacttggaatgggaacatgacgcatatggaattatctatcgcgtaaaagcatatactattcgatttaaagcatatttcgattcagtgtatttcccagaagcagctttacccggtaataaaggcttccgtcaaatttcagttattactaatccattagaagctaaaaagataccttctgagccaaataaaaaggctaagaatttatggtacaaccctattgatttaagccgtcattccggtgaaatgatttacatggaaaataggcctcctatcattatggctatggaccaaaccgaagaaattaacatcatcttcgaattctaatgcgggagcctgagggctcccatttttgtataaatagcatatatcaatagaggacttattatgttcgaacaagaagcaaagcaactaattgacgtcggtgaaattggtaacgcatcgaccggtgatattttgttcgatggcggtaacaaaattaataacaacttcaatggcatttataatgcatttggtgaccaaagaaaaatggccttagacaatggccaaggttctggagttggacaagtaattcatgctactggctattggcagaaatcaaatgacccactggaatttactactccagtaccaaacggctcgcaatatgacattgacacttcaggaggagctgtacaagttactttaagtaaaggcgttcgcggagaagcagtatttttctgcaacagcaatggctcattctctccaactaacccattaactattgatgcaaacgacacatttgcaactgtaacaggttcattaagaattacgtctccttacgtatttgtaaaatgctggtgtatttctgacgaaggcggccgttctgtttgggattattcagtagaaagtatgtttggtgaaaaacatattccaactgatggcacttggcaattaggagccgttggtacttcagtagatattccattatttcataatactgaatttactgtagcgaagtatcttattactgccgaaactagtaatggttcaaaagccaaaagttgcgaaataaatattcacatagacagaattaagaaagaagttaatagtgtagaatatgcggtaattcgaattggagcagttgacactccagctacttctactacacctgaagtgattgataaaattttcgttccttcatttgctattaaccctagcacaggatatgtagtcctgacattaacgccaggagtcgctggtttgagagcggcagttaaagctatcgctacacagaaaattgggaatccaagatgaagcaagatattaaaattggtcaagctgttgacgacggctccggcgactacctgcgtaagggtggtcaaaaaattaatgataactttgatgagttgtattacgagcttggcgatggagatgttccatttgctgctggtgcatggaaaaaccacaagacctctacagcagctacattaaacgccgaatggggtaaagcttatgtgcttgatacttcaacaggtcgtttaaatgtgcgtcttcctaaaggtactgcgaatgattataataaagtcattcgtttacgagacgtttatgcaacttggcaagttaaccctataactattattcctggttcaggagatactttaaaaggtgattctcgtccaagagaaattcgcactcaattcgctgacttggaaatggtgtattgccctccaggtcgttgggaatatgttgaaaataagcaaatcaacagaatttcaaatagtgaattgagcacagtagttcgtaaagagtttttagttaaaactaacggacaaactgatttccctgatgtattcagtggaacagaatacaacattggaaatacccaagtattccatcgtggtaacattctgtattacggtgagaaattcagtgcaactgattctgattttggttcaattggaccaaatggaacaagagttgctcttgatggtaaaagcattaagctgaaaaacccggctaatgcaggtgatactgtaattgtagtatcttacttagatggtatttctcaattccgtagttcttacaatagacgatcagttactctgagagattcatctaaaactaaccagacatctattgaaggttcattgttagttgacgatttaaaaactctcagatattttccattgagtgcatttggtattgatagtttttctcctgtaaaccatcaatccatggaagttcgttttaacggaatacttcagaatgaagctggtactgcaggtcttccattagctcgttgtattgatgctattgcagacgacgcatttacatgtcaggcacttggtggaacttggcaaaacagtaaacttgactatgttcttgatatcgatgacaataataaattgattggtatcgaaacagaccgtgaaatggaagatggcgacattattactttaacttggtacaacaaccaaattggtacagtaatggagcttgaagacattcttaatgaaactgacgcaaaatatgtatctaaaggcgaagttctcaatctcactggtcaagtacgtattactaaccaaaacaaaccaggttggcctaatgttgctcctgaaccagctgctgctgttgaagtaaataatgttcaaaacttatttgatttggtttatccgattggaacaatttacgaaaacgcagtaaaccctaataacccagcaacatatatgggatttggtacttgggttctgtggggacaaggtaaagttgttgctggctggaataacgatacaaccgaccctaatttcgcaatgaacaataacgatttggatgtaaatggtaatccaagtcatactgctggtggaactggtggtgtaattagcaatgaattagaaaatgctcaaattcctgcttctcaaacaaccgaaaaagttttagtagttgaccctaacggacctattgtcgtcggcggatgtcaatttgacccgaatgaacaagggccggcttatactaaatatcgtgaatcggttgctaacatcaacccgactcacacacctccaaaatcagtaactaatattcagccatatgttaccgcatatcgttggttaagggtttcttaatgattagtgtatcttcttcaaaggcgggacttaagtcccgcaatgcagatttcttgcaatatgaaatcgccccaggcagtattgatgttatgaatactcagccaattgggtcaaatacgatttcacaaaaatataaaggtgttgattttccaaatgttcaatcagcgatagaagatgttcgtggattcgctattcttccaattggaacaattgtaattaacgatactggcgtttctcctgaaggtattcaacaaattgatgattggacttttaccggaacagtagcagttgatggaaaatctgaaggtgaatcagttttagttgatgtatacggatttatggttccggctttaattggtgacactgacactgaatttgctgcgaaagttaaattagttcttgaagacgctattaccgccggtgacgtaatttcttcagttgaagtatctacatctgccggtaatattttaaacgttaaatatatcgataaccaagaacatattcttccctcatattcttcatgtggagtttccatctctgcttcaatccagtctccttctaaggttggttatgggtcatgggatttaatcggtcgtcaatcattaactttcgatggagctacttcaccgacagttttacaatactttaagagaatgggttaatggctactaatactctaaaccacataagtgacgaatcaaaatataaaacgtttaacccggctggaactagttttccagccaacataacaaacgttcaatcggcattagccgtattaaagccaatagcagttaacggcgttcctgacgcaactgaaactgttaaagggataattcgcattgctacccaacaagaagttaatgatggtgattcagctaatactgtagttactccaaaaactttaaaagaacgtcttggtaatccgcaagcttctactacagtaattggtttaactcgatatgctactacagctgaagccactgcagggtctattggcaatgctgctgttgttccaacagggttaaaagcttcaattgataatgcgtttgctactcgtatttctaaagagtcagttttaggtgtaattaaaattgctacagttgcaatggctgaagccggtactgatgatacctcggcaatgactccattgaaaacccaaagagcaattgcaaaagcaacagcagttcttccagtttatggaccagcgacagaatcagtaagtggtactgtgcgtattgctactaacgggcaagttgctcaaggaactctaagagacgggtatgccgtatctccaagtggattagcctctttaacagctacatcttctcgcagaggtttagctcgttccgctactatcgccgaagttaacgcaaatactgccggagatatttttgttactccaaatggattgaaccaaagagttggtactacttcaacaaaaggtcttgttaaattaacaactaccgtaggttcaggtgacgcaaatactgcattagcatataacgctgatgttgttcatactcgtggcggacaaactattaatggaaacacaacgtttggtacagctcgcgtaaatggtcgtttagatatgggctctggctttattaacaaccagcaaattgctactgttaatatgttagttgattctgttcctatcggaacaattatcatgtggccaggaaataaccctccaagctcagactggatgcattgtaacggagcgttattgaataaaggagatgcccaatattctactttgtatagcattattggcactatatatggcggagatgctactcggtttgctcttcctgatatgcgtggtatgttccctcgtggtgttggtaaatcaaacatcatgaaccaatattcaggaaacgactcaaaaggtaaacctggtcttggtgctggatgtggtaatgcttcattaggtcaatcaatgccgcaatctgttcgtaaacataaacacgaatcagggtggggtgaacatcatcagcgtaatgaagctcgcaacgggtgtactgtaagaaacggctatgttggttctaatagaacagattatgataactacaagtggtttactaatgatggtagtgaagtagaagcagctaatattcgtgattcattcggtactatgaatactgatggattaatgggtgatgaaaaccgtccttggtcaattgctctaaactttgttataaaagtaagataaggaaaaatatgtcaactattgatttaactccccttccttacgtcaacggccttccggatgaaggccaatctcgtgtaaactggattaaaaatggcgaggaattaacaggagcatccaccaaaaatggtgtagacggtaatctcaaccgtggaccggtgcaggtccaacaaaacgtggaagtgctcgatgggaatatcgtagttgtacgtaactctcttgagcaatcaaacgtaagaattaagaatgtcgaggatgccctaggggtcattggggatgtcgatgttgtcaaacaaataggtttaaacacatctgcaattaaagttctccagagtgacacagagggacttaaaaccacatcagatgaccatggtctgcgcataactcacatcgaagaagatgtaggtgaatatgacccgtcacgcgattctgtttaccgtccagttcgtgaagacttactttggattaaaactgagttaggtgcttatccggggcaagacatcaatggtatgtctattcctatggctccagcgcttggtttgaagaagcgtgttattgacactgctaaagctgtaaatgataactcgattcgtatcactaatattgaaaaacaatttaatgattcagatgttggttcattaactattgaagtccaaaaccttcgaaatgaaatgggtccaagagcatccgctggtattgataatgtttacgttcgtttgaataaaatgaatggaactattagtactttagcaatggacatggaaaacgttttagattcgattgggtataacaatggagttatcaatttatacggcttggttgtaattaaccgcgatgcaatcgctgaagtcaatcgtaaattaagtgacccgacagtaggattaattcctcgtgtagatttaattgaatcagctatcggaaaagattctcagccatcaagcatcaacggaagaattaaaattaaccgtgatgaaattacagctctgaaatctattgttggtgcagatacttcgtctggtttacgtggacaagttgcatggattaaccaagtagttggtattaatgaaagcggaacccctgctccgtctaattctttaattggacagattaatactctgactaccatgcaaaaccaaatggctaataccattcaggatatccaggtagatattggtaacaataacgaaggtttaaaaggtcaagtaattcgtttaaatagtcttgtaatggatacaaaccctaacggagctactgttgaagaaagaggacttttaaacgtagcaaaagcccaagacactgatatttcaaacattaaaaccgaaattcagaacttaattccagaagctcctcgtgatggaaaagcttatgttcgtaaagacggtgcttgggtcgacttagacactattcttaatccacctgcttcggaataagacccggcagcataatatagggccttcgggcccttagaggtttatatggccgcaaataccgcacgaaatccaaaagaacttaaagacgttattctgcgccgtcttggcgcaccaatcattaacgtcgaattaaccgaagatatgatttatgattgtatccaacgagctttagagctattcggtgaatatcattatgacggcttaaataaaggctatcaagtaattcatattggcgatgacgaaatcggtcgtggtcaattcaaaaatggtgtgtttgatttttcagaccgcaacattttcgcagtcacacaaattgttcgtactaacgttggttcactgacaagtatggacggtaatgctacttatccatggttcactgatttcctattaggaatggctggaattaatggtggtatgggtagctcttgtaataaagcttatggaccaaatgcatttggagctgatcttggctatttcactcagctcacaacttattggtcgatgatgcaagatatgctcgctcctcttccagatttttggttcaacgatgccactggtcagcttaaaattatgggcaacttccagctaggtgatgttattgtagttgaatgctggactaaatcttatattgatgtggacaaaatggttggaaataaagctggatatggaacagcaggcccagaaacatcttggactcttcctgatgtgtatgataatccagataaacgtttgactggttacagggctggtgaagaactttcaattgttcaaggttcttataacaatcgttgggtaaaagattatgctcatattctggccaaagaattacttggtcaagtattagctcgtcaccaaggtatgcagcttccaggcggagtcacattaaatggtgaacgcttaattgaagaagctcgattagaaaaagaatatgctttggaacagctttacttacttgaccctccaacaggagtacttgtaggatgatgaataaaaatttgttcgcgaagctcgagaacaaatcaggttattcacgcactaatgaagaggaagttctcaatccatatgtgaacttccacaatcattttaacacccaagctctgtttgatactcttgtggctgaaagtattcaaatgcgcggggttaaatgttactacgttccccgtgaatacgtaaaacctgattatgtctttggtgaagaccttcagtccaagttcactaaggcttggcaatttgcagcttacattaactcatttgagggttatgaaggagcaaatacattttatagtaagttcggaatgcaagttaatgatgaagttactttgtcaattaacccgggtctctttaagcatcaagtaaatggacaagaaccgaaggaaggagacttaatttacttcccgatggacaatagcttgtttgaaatttcttgggtagagccgtatgacccgttctatcaagctggacgaaatgctattcgtaagattacagcagagaaattcatttattctggtgagcagcttaaacctgagcttcagcgtaatgatggaattaacattcctgagttcagcgagcttgatttagaccctattcatgaattagatggtctttctgatatcaatgaagttccatatcaagaagtagaccaaatgaatgatgaggctgataaagacgttaagcaatacgaagtcgttaatggtaccggttcacctaaggtagaaccaccaagaaacagaccacctgctaatcatgtagcatctccatttgatgatggttttatgctataaatagttaaaagcatatacggctcttcggagccgttaggagaaacaatgttcggatatttttataactcgtctttgcgcagatacatcctaatgctgggtgacttgttctccaatattcaagttcagagagtgcgcgaagacataggcaagacatatatcagagttccaattacttacgcttctaaagagcactttatgatgaagctgaataaatggacttctgttaacaatgaagacggtcctgcgaaagtagagacaattcttccacgtatcaaccttcatttagttgatatgatgtacaacccaacttataagactggacaacttaatcgttcagcaatgagcaatcctaattcgaagactgggactatttctcaatacaacccaactccgattaaaatgatttttgagcttggaatttttactcgtcaccaggacgatatgtttcaaattgtagagcaaattatgccctacttccaacctcattttaacaccacaatgactgaactattcgaaaacgaaattacatttgaaagagatataagaataactttccaatctatttcaattgacgaacaaatcgatggagacaaacaatctagaagaagattagaatggtccatcatgtttgaagtgaatggttggctttatcctccagctttcgatttaagtggtgaaatccgtacaatttatcttgatttccatgctaacagtcgtgaattggtaaatgaaggtgtatttgaatctgtggattctgaagtagacccgcgcgatgttgaaattgaagattgggacggaaaatctattcagaaatatgacagcgattcaactccaattccaaaagagcctgaaccgtctggaccacgaggtgtataatgagcgaacaattagacattactaaattgctggatattggggatttacctggaattactggagaagaggttctggcatatgagcctcttcaattaattcctgttgaaagccatccacaaaacagaactcctgacctcgaagatgactacacaatagtccgtagaaatatgcatcaccaatcacaaatgctaatggatgcagctaaaatattccttgaaacagcgaagaactccgattctcctcgccacatggaagtattttctacgttaattggtcagatgacttctactaacaaagaattgttaagacttcacaaggaaatgaaagaaatcaccaacgagaacactaacactaaaggtgctggtaatcaagcggtgaacatcaataatgctacagtgtttgtaggctctccatcagatatgatggatgaatatggcgatgcgtatgaagcgcaagaagccagagaagagaaggtaataaatggaacaacctcttaacgtactaaatgattatcacccgttgaatgaaggacaaaaaattgtcattcgtccaccggggtctttagagaaaaagattgaggatgggataacatttttcaaatctcaatgggatgaaaagtggtatcccgaaaagtttgaagattatcttcgcattcaccaaattgtaaagattcgtcttcaaggagaagacccaactaatttcggtacatttaaagacaagaacaataaacgctccagatatatggggcttccgaaccttaaaagagcgaatattaaaaccaactggactagagaaatggttcaggaatggaagaaatgtcgtgatgacatagtctattttgctgagaaatattgtgccattacccacattgactatggtacaatcaaggttcaattgcgtgattatcagcgagatatgctgagaatcatgtcttccaaacgtatgacttgttgtaacctgtctcgtcagcttggtaaaaccacagtagtagcaatatttttagcgcacttcgtttgttttaataaagataaggctgttggtattttggctcacaaagggtcgatgtcagcagaagtattggaccgtacgaagcaagctatcgaattactcccggactttttacagcccggtatcgttgaatggaacaaaggctcaattgagcttgacaatggttcttcaatcggggcatatgcatcatctcctgacgccgttcgtggtaactcctttgcgatgatctacattgacgaatgtgcgtttattccaaactttattgacgcttggttagcaatccagccagtaatttcttctggtcgtcgttcaaaaattattatcacaacgacaccaaatggattgaaccacttctatgatatttgggatgctgcattatctggtaagtctggttttgagccgtacactgcaatctggaactcggttaaagagcgtctttataacgaccaagatatgtttgatgatggttggcaatggtcatctcagactatttcagcttcttcattagaacaatttaagcaagaacactgtgcagaattccatggtacttcaggtactctgatttctggtatgaaacttgctaatatggattggactgaagtaactccagacaatcatggattctataagtttaaagaagcccagccggaaagaaaatatatcgctgcattggactgttcagaaggccgtggacaagactatcatgcattacatataattgacatcactgaacctcaatgggaacaggttggtgttcttcactccaatagcatatcgcatcttatccttccagatatcgtgcataaatatctaatggagtacaacgaagctccagtttatattgaactgaatagtaccggcgtatcagttgctaaatctctttacatggatttggaatatgaaaacgtaatttgtgattcaatggttgaccttgggatgaaacagactaagcgtactaaagcagttggttgttctacgcttaaagaccttattgaaaaagataagcttatcatccatcacaaagctactgttcaagaattcaggacattctctgaaaaaggagtatcctgggcggctgaagaaggttatcatgacgacttaatcatgggtctcgtaatcttcgcatggcttacaacgcaaactaagtttgcagattatgctgacaaagacgaccttcgactcgcttcggaagtattccggaacgaattagaagatatgaatgacgattacgctccagtggttttagtagacgacggacgtgacgttacagattacacgccaactcacggtgtgtcgtttatataaatatactaaagcacacatgtagaggaattcttaatggctttattatctccgggcgttgagctcaaagaaactagtgtacaaagcactattgttaataatgctactgggcgtgcggccctggctggtaaattccagtggggtccggttggtcaagttgttcaagtgactaacgaagtcgaattagtcgatattttcggcactccagatagcgaaactgctgattactttatgtcagcaatgaacttcctgcaatatggtaatgatcttcgtatttctcgtgcagtaaatcgcgaagtagctaaaaactcatctccaattgctgggaacgttgaaatcaccatttctgctgcgggttcaaactatgctgtaggcgataccgttcgagttaaatacaacgtaaacgttattgaatcagctggtaaagttactgctgttgatggtaacggtggtattgtttcagtttcagtaccaagcgcaaaaattattgcatacgcaaaatcaattaatcaatacccagatttaggaccgaactggactgctgaagttacttccgcatcttctggtgttgctgctactctggccgttggtaaagttgtaactgattctggtgttcttttaactgagccagaaactgcgactgagcaaatgacttcggtcgaattccaagctgctttgaaaacttatggcatgccaggtatcgctgctctttatccaggtgaacttggttctcaattagaaattgaaattgtttctaaagctggatttgaacaaggtgcaaacacccaattacaaatttatcctgctggcggaactcgtgtttctactgcccgtgcagtatttggatacggtcctcagtcagatgaccaatattgcattatcgttcgtcgtgacggagcaattgtagaaagcttcgtgctgtctacagcaaaaggttctaaggacgtttacggaaataacatctttatcgatgatttcttctctaaaggttcaagcaattatatcttcgctactgctgaaggctggccaactggattctctggtattgttcagctgtcaggcggtgtatcagctaacgaatctgttactgctggcgatgtaatgcaagcatgggatttattcgctgaccgtgaagctcttcatgttaaccttttaattgctggtgcatgtgctggtgaagatgacgaatttgcatctactgttcaaaaacatgtagtatcgattgctgatgaacgtcaagattgtctggctcttatctctccgccacgtagcgtattggtaaacattcctctgactcgtgcgattgataatctggtcgattggcgtacaggtcaaggtacatacgctgatgctaatatgaacatcagttctacttacgcatctatcgacggtaactacaaatatcagtacgacaaatataacgatgttaaccgttgggttccgttagctgctgatatggctggtctgtgtgctcgtactgataatatcagtcagccttggatgtctccagctggttataatcgtggacagattctgaacgtcattaaattggcaatcgaacctcgtcagagtcaacgcgatcgtctgtatcaggaagcaattaaccctgtgaccggtaccggtggtgacggattcgttctgtttggcgataagactgcaaccaaagttcctactccgtttgaccgcatcaacgtacgtcgtctgttcaacatgctgaaaacgaatattggaaacgcttctaaatatcgtctgttcgagatgaacgacaacttcactcgttcaagcttccgtatggaaacttctcagtacctgtctggaattaaatctctgggtggtgtatatgaattccgtgtggtatgtgatactacgaacaacacgcctgctgtaatcgaccgcaatgaatttgttgcatcgttctacatcaagccagctcgttctatcaactacatcactctgaacttcgttgctaccgcaacaggtgctgatttcgatgaactgattggaccgcaagctcaataattctaagacatttagggaccttcgagaggaggtccataaatacaatcatcttaggaaactaaattcatctcagccgctctggcgaatcagagcggtataaatataacaggaacaaacaatggaattaaccgacctcacaagagcgttcgaatccggtgatttcgcgcgtcctaacctgtttgaagtagaaattccttatcttggtaagaacttcagcttcaaatgtaaggcagctccactgccagctggtattgttgaaaaaattccggttggttatatgaaccgtaagttgaacgttgcgggtgaccgtacgttcgatgattggaccgtgactatctacaacgatgatgctcataatactcgtcaagctattgttgaatggcaaggtatcgcagcaggtcaaggtaatgaaattactggtggctcacctgcagagtataagaaaaaagcaattgtccgtcaattcgcacgtgatagtaaaacaatcactcgtgaaattgaaattacgggcgtttggccaactaacgttggtgaagtgcaattagattgggattcgaataatgaggtagaaacattcgaagtaacattctgtctcgactggtggttgtaataaatatattcaaacaacgaagttaaggtttgaatatgtattgcacttatcttactgtatacacggggaataaacttccccgtcgttatattggttctactactgtatcaagaataaatgaaaattatcatgggtcagttaaatctaagaaatataaagaaatctggatttctgagcttcgtgacaatcctcatttgtttaaaacaagaattcttaaaacttttagttctcatcgagatgctttaaatgaagaattaagggttcagaaaaaatatgatgtagttcgttctaaaaactatatcaatatgtcttttgctcaaccaaacgggttctttgggatgtccactaaaggaattccgatgtcagaagaagctaaactaaaacaaagaatacaaagacttggtataaaacgaccagaacattcgaaaatattatctggtaggaaaagaccaaatcagtctaaattaatgactggtgatggaaacccgatgtatggtaaagagcatccagcaaaaggcaaaaagataaatcaaccaagagctgtatgccaagtttgtggagttgaaagcacaagaagtgctatttctcgttaccacaaaaactgtaataaatattagtatgctttaacccttattggagactctaatgaaatttgacgtcttaagtttgttcgcgccgtgggccaaagtcgacgaacaggaatacgaccaacagctaaataataatttagagtctatcacggcccctaaatttgatgacggcgcgacagagattgaatcggaacgtggagacattgcaggcgctggattattccagagaatgtacggtcaaaatgaaccgggaatgaaaaacaccagggagcttatcgatacttaccgtcagttaatgaataactacgaagtagataacgctgtccaagaaatcgtcttagatgcaattgtatacgaagatgatcatccagtggtttcattggatttagataacactgattttagccaggcgattaaagaccgtttacaagaagaatttaacgaagttcttacttgtctgaattttgaaagaaagggtcttgaccatttccgtcgctggtatgtcgattctcgtatcttcttccataaaattattaaccctaaaaaaccgaaagaaggtattcaagagcttcgtcgtttagaccctcgcaatattcagttcgttcgtgaagttatcactgacactgaagcgggcgttaaaattgttaaaggctacaaagaatatttcgtttataacaccggtcacgagtcttatcaatgtgacggtcgaatttacgacgctggaacgaaaattaaaattccaaaggctgcagttgtttatgcacactctggattagttgattgttcaggaagaaacatcatcggttatttgcaccgagctgttaaacctgctaaccagcttaaactgcttgaagacgcaatggtgatttatcgtattacacgtgcgccagaccgtcgagtattttacattgacacagggaacatgccttcccgtaaagctgctgctcatatgcaacacatcatgaacaccatgaaaaaccgtgtggtatatgatgcatctactggtaaaattaaaaaccagcagcacaatatgtcaatgacagaagattattggttacagcgccgtgatggcaaagctgttactgaaattgataatatgcctggtgcttcaggtatgaacgaaatggacgatgtccgttggttcaaaaacaacctttaccaagcattacgtgttccactgtctcgtatcccgaatgaccaacaaagtggagttcagtttgatgctggaactggaattacacgtgacgagttacaatttgctaaattcattcgtgaactgcagcataagtttgaagaaattttcctcgaccctcttaaaacaaaccttattttgaaaggcgtaatgagcgaagatgattggaaagatgaaataaataacattaagatagtatttcatcgtgacagttacttcactgaacttaaagatgctgaagtcactgaacgcagattcaatatgcttcaaatggccgaaccgtttatcggtaagtatatttctcatcagactgcaatgaagactattcttcaaatgactgatgaacaaattgaccaagaggctaagcaaattgagctagagtctaaagaggctcgtttccaagacccagaccaagaacaagaggatttctaatggaagatttcatctccgcactcaaatccaacgacctcgttaaagctaagaaagcctttggtgctattatgcttgaacagaccgctgatttgattagccaacgtcgtgttgagattgcccaatctgttatgattgaaggcgaagaaaaagaagacgacgaaaaagatgattctgaagatgaaggtaaagaaaaacctgaatctaaagatgaaaaagattctgaagacgaagacgaagaataaggagtcgcaatgctgattgttcctgatgagtacgaagtcgtacttgaaaacatcgaagcagctattcctgaagccgaatctcgttttaagcagttgtcagaagctctcgataaagcagacataaatacaattgtagaaaacatgttgccaattgaacctgaagtagcaattgctatgggttcactgaatgaagaaatgcagctcaatgaatttatcgttaagcatgtttcttctcgtggagaaattacgcgtactaaagaccgtaaaacccgcgagcgtcaagcattccaaacaactggtttatctaaagctaaacgtcgcgctatcgctcgaaaagtcgttaagtccaaacgcgctaatccgtctggtactgtacgaggcaaccgcaaacgtaagaaagctatgaaacgtcgtcaggcgttaggattaagctaatgaatgaaccccaattactcattgagcattggggtcaacccggcgaaattttgaatggcgtaccgatgcttgagtcatacgatggctcagatgcagggttaaaacctggattatacatcgaaggcgtgttcatgcaagccgaagtagttaaccgaaataagcgtctttatccaaaaagagtattggaaaaagccgtagctaattatattaaagagcaggtttctactaaacaagcacttggagaattaaatcacccaccacgtgctaacgttgacccgatgcaagccgcaatcatcatcgaagatatgtggtggaaaggaaacgatgtttatggacgagctcgtattattgaaggtgaccacggtcctggagataaactcgctgcaaacattcgtgctggctggattcctggagtatctagtcgtggactaggctctttaacggaaaccaataaaggctaccgtatcgtaaacgaaggatttaaactcaccgttggcgttgatgctgtgtgggggccttctgcaccagatgcttgggtaactccgaagcagatttcggaatccgctgaggcgcaagtcgccaaaaagaatgacgatgagtcatttaaagctctcgtagagagtctcgaaaaagcattataaataataatgtaacttaacaacaggactaacaaaatgctgaaagacatcctgctccaggaagctcagaatattgaagctaccgtagctgtggacagtattttcgaatcggtcgagctttctccggaagtaaaagcgaagttcgaaactgtattcgaagcaactgtgaagaaacatgccgttgaattggctgaatcccacattaccaaaattgctgaaatggctgacgaaaagctgaaagacgctaaagaagaagccgaagaaaaagctgaaaagaaactgacagaacatgcttctcgtttcttcaatcacatcgctcaagaatggatgaacgaaaacaaactggctgttgataaaggcatcaaagctgaactgtttgaatccatgttcgctggtatgaaagagctgttcgttgaacacaacgttgttctgccagaagaatcagttgatgtagttgctgaaatggaagaagaactggctgaagctcgtgaagaaatcagcaatctgttcgaaggtatttctgctcgcgacgaaaaaattaataccatgctgcgtgaaagcgctgtaatggaatcaactaaagacttgaccgacgttcagaaagagaaagtagcttctctgaccgaaggtatggaatattccgacgaattctcaagtaagctgtctgccatcgtcgaaatggttaaaggctccgtcgagaaagaggtagtaaatgaaagcataaatactaccgacaatgatgctgacggtctcaacttcattactgaagaacacattgagccagaagaaaaagtatcaaaacagccatcgatgatggacgcatacgtagcctctgcggcacgtctttcttaatttttaaaaggttataaaacacatgaaaaagattaatccgttagtagaaaaatggactccgctgcttgagaacgaagcactgcctgaaatcgttggtgctggtaaaaaagctctgattgcaaaaatcatggaaaaccaggaatcagctattaaaactgaacctgcattccgtgatgaaaaaatcgctgaagcatttggttcgttcctgactgaagcagaaattggtggtgaccacggttatgatgctcaaaacatcgctgctggccagacatcaggcgcagtaactcagattggaccagctgttatgggcatggtacgtcgtgcaattcctaacctgattgctttcgacatctgcggtgttcagccaatgagttctccaaccggtcaggtattcgctctgcgtgccgtttacggtaaagaccctctggctgttggcgctaaagaagcattccacccaatgtacgctccagatgcaatgttctctggtcagggtgctgctgagaaattcgctcctgtaaaagctgctgacgttctgactgttggtactatcgtagttcacgatttcgctgatgttggtcgcgcttacttccaggttgctgaaggtttcaccgtagacgctggtgctaccgatgctgaaaaactggataaagcagttaaagctgctgaagaagctggtcagctggtagaaatcgctgaaggtatggctacctctgttgcggaactgcaggagaacttcaacggttctactgacaacccatggaatgaaatgggcttccgtatcgataagcaagttatcgaagctaaatcccgtcagctgaaagctcagtactctattgaactggctcaagacttacgtgctgttcacggtatggatgcagatgctgaactgtctggtattctggctacagaaatcatgctggaaatcaaccgtgaagttgtagactggattaactactctgcacaactgggtaaaaccggtatgactcagaccgttggttctaaagctggtgtatttgacttccaggacccagtagatattcgtggcgctcgttgggcaggtgaaagcttcaaagctcttctgttccaaatcgataaagaagctgctgaaatcgcacgtcagactggtcgtggtgctggtaacttcatcatcgcttctcgtaacgtagttaacgctctggcagctgttgacactggcgttactcctgctgctcagggtctgggtcaaggcttcaacgctgataccactaagactgtgttcgcaggtattctgggcggtcgttataaagtatacatcgaccagtacgctcgtcaggactacttcaccattggttacaaaggtgctaacgagatggatgctggtatctactacgctccatacgttgctctgactccactgcgtggttccgacccgaaaaacttccagccggtcatggggttcaaaacccgttacggtattggtatcaacccgtttgctgatagtgcatcacagcagccgaatgctcgcattcagtctggtatgccttctatcgtcaactccgttggtaagaacgcgtacttccgtcgcatctgggttaaaggtctgtaatccaattaaatgggagccgcaaggctcccattgttgtttctacggatgataaataaaagtataatccactagaggaaaagcgacgatggctaacatccatgaccttctgcgcgaatcaactacaacgacgagttcaatttctgcccgtcctagcctcgttgcattgactcgcgctactactaaattaatttactctgatattgtagctactcagcgtactactcaacctactgctgctttctatggtatcaaatacttgaaccctaacaaagaattaacgttccttactggtgctacctacgcaggtcaaactggtactgaggaccgtaaatctattgaaacattaactgcttcaaataaagattcatttggcaagggcgatttattcaaatacaatgacattgtttacaaagtacttgtagataatccatttgaccagattactgaaactgatttagaagttgtaattcagatttctctggttaaactcactactcgtttaatgtctgatgctgctatcacttccaagtttgaaactgctggagctgatatcgctgaagctaaattccaaattgataaatggcagactcaggttaaatctcgtaaacttaaaacaagtttgactgttgaattggcccaggaccttgaagctaacggctttgatgcttctaattttatcgatgatttactggctactgaaatggccgatgaaattaacaaagacattttacaaagtcttgtgacagtttcaaaacgatataaagttgaaggtatcacagatactggattcatcgatttatcttatgcatctgccccagaagctggtcgttctctgtatcgcatggtatgcgaaatggtttctcatattcagcgctcaacatcctttacagcaacattcgctgtagcatctactcgtgctgccgctgttcttgctgcatcaggttggttgaaacatcaagctggagatgatgaatatctatcagagaatgcttatggtttcctggcaaacggtttgcctctgtattgcgatactaacactccacttgattatgtaattgttggtgtagtagaagatattggtgataaagaagttgtatcgagtattttctatgctccatacactgaaggtatcgaccttgatgacccggaacatgttggtgcatttaaagtaattgttgacccagaaagcttacagccttctgtagctttactcgttcgttatgcactgtctgctaacccgtatactgtagctaaagatgaaaaggaagctcgaatcattgatggcggggatatggataagatggcaggacgttctgatttatcagttcttcttggtgttaagttaccaaaaatcatcattgaagactaaaagaaagggaacctcgcggttcccttttgtagttataaagcaaatatatcaaatgttggtgcatacttgtctttgaatttctgatagatttccttctcatacaagttatagcaaggtatcccatgacgcttggctatctcaacggccactcgtgtccctccagtgacgctagagagtcttaccggcgcatagaatagtaccatatctacgggtgattgacagtcctctccgagtacctggagcgcattacgggcaaataaagtcttcactatatcccggcactcatcccagtaacttgtcacttctcttgctttaattacactcctgattctcacttcatttggaaaatctttccacacctttactccaactccggttttaagaccattgaagccttcgtatggtatgatacgtaatgaacgctcacggtcgtatctactgagccatgattcatctgcaccaggagctcctcccgaatacgaaaaatggcctgactccgaaagagcctgaccagttaatgacatgacatctaaaacacgacgtggcgtctctcgagaaccgattaacgccaaacgcattagttacttaccagttcaatccaaaccggacgaattacgccttgaacgtaattgacaagttctttcttgactacatcaggattatcagcatcagtaatgaagatttcttcacgaccagcttcttccagaatatcctggacagtaagacccataactttaccaaagtcctttggacccacttgaccaatcttactgataacgttattgactcggttcagagtagcataagctgccagggtggagaaagctaccttatcaacatcagtcagttcaaccttagctttaataggcttatcggatttagctttctcagagaacttggagttcttgcatttaatagctacacgagaaccatttgggaagaactttggatagcatggtttcagaacatatccttcagcgacgttttcatttgatacaacagcatcatatgttgcagtgttagcaatttctaaaccagcatctctcacgatatcgttgtaataatttacaacaacagataagtcatttggaattttagcaagttcatcaaatttaccacggcccagtaatggagccatcttaaatccaaagacattacacatacgttccatcatgaaatcatcaacataagatgattcaccagattcagtagtcactttaatatcaaagacgtagaagtctttttcaccgtagtcaacacctttctgaataccaccgccagcaaattcaccaaagatttgataagctaccgtagcaccactcagtgcagcttgaacagctttaaaggactcgttataacgacccatgataaccatatagccaaagaaatcttctgctggcagaatagggccagtacgcttggcaggttgaatgctatctttagttacgatgacagagaagttagtgccgtgaattttctcacgtgctacccaagtttcagttacatcaaaaccagcattacgaatgcgctcaatgaatttaccgttgtagtggttctcgagcgttgaatatttctcaaacatatttcaccttagaatttaattttgaaagactgaccttgatagtcagcattgaactcatatgagaagccatttttagaaaagaatactttcatagcttctacattattgctccatttttctggaacaatataaaacgtttcaaacttaccacgttgtgctgcgttccgcaggttatctttaatatgagctttaatatcttctggtagttcatcacgcacaccctgtgccaatgctctgtattcttgagctagactcattataatcaccgtataaatatcaataattagggagggttctatccttctatggtcaagcgtatgtactagaaagaatccgtgaaaccattataccacgcggattctttaagcatattatagagggattactttatacttcttattgccacgagcatcacgcttacaaactaatttgcacttcgtaccgcttgcgatagtgtagtcttcatcaaccttcatccgcatccagtctaataccattccagatgggttaaaagatttttcaacttcaaccataatcttcgttccagatttatagaacttcgattcttgttgtacatggtcagccaatgctcgagaaaatgcagacggactcaggaatttgttataaccatgagctgcagctacaaatgtgttatctaatgcatgctgaatgtttttgataactaccttagaatatccaaggtgtttttcaggatactgattcattaaatcccctcatatgttttacgagttgttgatgacgagattctacatcagtattagataagcgtttacgatagacgatgatttctcttcgtttaactcgtgaccgagcggcttcaacctttgcgtaatgcagtgcagcttcttctggcttaatgccagcttctcgagcgatttcaataaagctcatgccgttttcatgcttaaaatgaatctcaatcggtgtcattactttatcctacagtgaaagttgttggtataataccactctctagaaaaagcaaaaggagccttcgggctccttttaatagatgataccagcttctaaagctgaacgatgaacaatacgtccattccgtgattcttgcacatcaacttctggataatcatctagcattttagctagtgtatatcgatgcaagtaataatcgctgtcggtgtcatcaagtttccaatcttttcctgcgacagtcatttcttggatttcatccatgacccaccaaccacaccagatataggctgttcctcggaatggcagaggatgaatatacggaagttctccatcaggaacaggagctacccttttagtaatagttacatcaccagttgtagtgactgtaacgggtttataatctggagcagaaacaacaaccgaaacctcaattacttgtgacccgatagtagatgtatcaacttctagagtacttgttgaaccttcaacaggggaaccgtctttggtccatgaataaactccggatgcaccttctggcgcaccgataacgttggctttaaaagatgcatcagacccctgttcgactgtaatagactcaggagtcaaagcaacagaaaccccactcatggtctttttagtaaaaataaccgcaacccctttagtcgcagtagccgggttgtaatctgctgcagaaaccgtggcttcacagttcaaagtgtaattagcttctgctgattcagttactgtaattgttttagctgtttggccctcaataacgtcagcaccacgtttccaaacataagcaatgcttgctcctgctggtgcgccagtaacatcagctgtaactacttgagattgcccaatttctttagaaacagatgttgggctcaaagttaaagtaatcgcaggcatagttttgttctgaactgtcagagtagtttctgcttcagccgtttcaggttcaccttcagccggagtaacagtagcaactactttaacagtcttactacctgcgggtccttcagcaatataattcatagcttcggtaacagaagattgcggtgtgccatttacagtccatacaaacgattctgtaccttcagctgtggcgccagaagttgttgcagtaaaattagttgtagttccaatgactgctgaagcagccaaaggagcaatagatacggtatacgccataagaatttccttattttaaagtcacaaatgaagaattgcgagtttcacgaatcataatagacccgtttcttttaatgtaataaattaagctaaataacgtttggtgagctgatgggtgtccaaacgatgttgggcgagatttccaatccggattatctttaatccattggtaaatccaccaaggaagagtaacatatcctggattcttacctaacaattgcgtgtttggactaaagttttcgggaagctcaacaatttcttcattaaacttttcttgagtgattgcagtcactggaatagtatgaactttatcatctgcaactgtaatcacggaatcaccgattggggcttcaagaataacgcctttaaccgggtccattggcttaccaaaatgagggtcgatatcagttactttcacttgtggcgcatcagaagatacagaatcaatcaatagacgagcttcttctttagcctcatctttaaaaatagcagtgcctttggcctcgtcgtcagcttgaataaggtcatagattgaaagaccgtcattctgctctggcatgggttcattagcaagtttggccaattcgacttcaaggtcagcgaccatattgtcaaaggctttagttttcttcagcttgatgccgaaggtttcagcgtactcggcaagcttttctttggcttcttttttctcaagtgcaccgatttcagcaatataatctttatctaacatagtagcctcgttgtgtataaatataaatgtatttataactaaggaatcggcaatgcacgatatcaatgtaaaatttcatgattttagtcatgtgtttattgagtgtgatgaatccacattccatgaactaagagactattttagttttgaagctgatggctacaaattcaatccaaagtatcgttatggacattgggatggacgtattcgtcttctgaactatgaccgtctgttaccgttcggcctcgtcggacaaatccgtaaattcgcaaacaacatgggttattcagtttacttcgaaccgaagatttttgagactgaagaaattactcgtaaagattttgatgactggcttggtaatcttaacatttactctgggagtaaaaagattgagcctcactggtatcagaaagatgccgtgtttgaaggtttagtaaaccgtcgtcgaattttgaaccttccaacatctgctggtaaatctttaatccagtgcttacttgctcgttattatgttgagaactacgaaggtaaaattttaatcatcgttccaacaacagcattagttgaccagatgattaatgacttctgtgattatcgtctgtttggcaaacagcattgtcttggtattcgttcaggcacaaagcgcgattcagatgcaatgatttatgttgccacttggcagacagccgttaaacaaccaaaagaatggtttcaccaattcggcatgatgatgaacgatgaatgtcatctggctactggtaaatctatttctactatcgttgctggtttaaataattgcatgtttaagttcggcttatctggttcattaaaagacggtaaagctaacgtgatgcagtatgttggaatgttcggtgaaatcttccgtccagtttcaacatctcagcttatggaagatggccaagtaactgacttaaaaattaactcaatcttccttcgttacccagacgaattcaccactaaaatgaaaggtaaaacttaccaagaagaaatcaaggtaattaccagtgcaaaacgtcgtaacaaatgggtagctaatttagctgttaaactggccaaaagaaatgaaaacgcgttcttgatgttcaaacatgttgctcatggtaaagagctgtttgaaatgattaaagaacttgggcatgagaaagtgtattacgtttcaggcgaagtatcaactgaagttcgtaacgcattgaaagtgatggctgaaagtggtacggggattattgtagttgcatcttatggtgtattctctactggtatttccgttaagaatcttcaccatgttattttagctcatccagttaagtctaaaattatcgttctgcaaactatcggtcgtgtacttcgtaagcatgattctaaatcagttgctacagtatgggatatcatcgatgatatgggtgttaaaccaaaatcagcaaatgccaagaagaaatacgttcatttgaactatgctttaaagcacgcgctggagcgcattcagagatatgcagacgaaaaattcaattacgtaatgaaacaaatcgatatttgaggaagttatgaaaacattcgaagaagtcatttacgaagctactatcgatacgtttatgagtaagattgctcaatgccagactttggaaggtttagaagaactggaagcttattacaaaaagcgtgttaaagaagctgacctgaaagatactgatgatatctctattcgagatgcattggcaggaaaaagaatggaatttgaatctgaagatgagtcagagtcggaagaagaattctaataaaaaggcccctcgaaagaggggcaaaccacaagtggcataaaacactaggctacattaaaagttgcgtttcgtttaattgctcttctgcgctttcgcttaccggcaattcaatcgcataattataacaagcacctggatgaacagggcctttatctgtttcaacaaccaacgccgaatcaatcggttgcttacagacagcacaaatcttttcagacatgattgtctcctcagttattaacaattctatttataagtttgtttataaacttccattgccaccaatttgtctcatatgcatgtcaattcccatattttcttcatagaaatagacatctaagtaaccagcgaactttcctttgatataaagtacatcttcaccgactggatggtctgggacgatacgaatatcatcccttctaacacgtcgcgacttcatcaaaaactgtatttcagtttcaaactcatccattactcaccagcttcaaatttacgcatatcaataatatgcttgattgagaatccacgagatttgatagcgtccattgcatcacgacagaactctaacaaaatcccccaatattgcaaactggtatcaatacgaagtacttctttatcagcagacagaacagtcttcatttcagacttttcataacggtccatgctgaactcgtcaccatcgcctctgcctgtgtaataatccaacttctgctttaacgcggacttcttcgaagcctcgatgcgaagcatttctttacgaatagcagacaattttgtcaaccacttaccataaagaactggattattagctgcttcatactgcaatttagttgaatcaataatcaaatcttgtttcaactcctcttggagctcttcaagtttcactcgttttcctcttaaaatattcaaccattccagcataatctacagctggaaacccattgttcttagctatagtaccaaatttaccacgttttggtttattattgcttaaccaaagagagtacaattcagtttctttatcccatggtatagctgagcttcttttagatatctttgtagagtctttagcccaatgagattgggttttaaacttttctttcattgatttagatattttaagttttctttcatttgagcatgggcgctttaatccactcattggatgtatttcccatactctgcctccatctccaccatctgcaatgttaacacaattgctgaatttttcttttgcttctcttataagcaaattttcaaattcagcgtttagttcagcggtttcaaatgtggcaagcacatatttttcaaatcttatactcggattctttttggcatcttttatagccttgccagaacctatatacttattgtttaaaccgcatctagaagaatgttttccaaaatacagttttattccgttatcacttataattttagtaagatagcaataatggtccataatcacctttctttgttcaatttattactctagcaaggaactcaaaaccattataaccatctcaaacgaaagcgattagttacggcttgagcttgccaactgaagcttaatctgctcaaggtcgtccgggttgtcaactacagagaaccgaacttcaacgataagcgtatggtcatcgtaaaccggagtaacattcacttgtagacgacggactcgcggttcatagtttcttatagcagatatgatatttcgttctactgtatcagctgtcagaggagtcatgttctcgaaaagctggtcttgtaaatcacacccaaagttagggtcgaatggacggcttccctttcttgttgttataatacctaaaagagagtttttaattgctcgtaacccacgagcacgtgccacgtctttggaccaatccattttaagttcagggtccaaatccgaataaaggtcatttatatttgccattacagatacctgaagaattctttaaggcctttaatcacttcaacgtgagttgctccgcatttctgacatttcacaggaactgctagataaacggtaggctttaaaagcatatttttgatgcggataatatcctcttcagtgatagctgagtaaaggtcatcgatttctttgtcattcaaatcttcgattgaaatggtttcaccattcacatagatgtactctatacatgtagcaatcatctgtgcgatgttcttatcatcgaataattttggataacgaagcttaagtttaaaattcgctagaggataccagagttcctctggttcatcgatttgtgcagatgtaaagttaatcggtgttaatgtttcgtgaccttctggacatatccagatgttctcatgattaacctcacctaatgagtgagaccataactgaatcagcagaagttctgattcttgcttgttaaggtttttcgctgatgtacaattattaatcagccgttttactacttcatcaatgtttccattgattttgccatcgatgagctctttgtattcttctaacgtaaaagctctgcattgaatatcagagccattaatctggacttcaaatttgtaatcgtagttcatattagctccttacggactatttataaatatttcaataaaggagacctctatggccaatataattcgttgtgtactaccggacggggtccatcgttttaaacccttcacggtagctgattacagagatttccttctggttcgtaacgatatgcaacataaaacttacgaagaacagaaggtgattataaaagaacttttagctgattactttggtgaataccctgagactttacgtccatatatgttcatgaaagtattcactggctcaatcggtaaaacaaaaattccagtagctttcacttgtccgacttgcgaaaaacaaaagcaagttctgtttgatatcagtcaagaggatttggttgaacctactattgaagtggctggaatcacaatagctttcaaattccctgaaaaggaatacgaagataaagctgcaatgatttatgattgcattaaagcaattaaatacaacaatcaatggtatccttggaaagagatgtcggaagacaaccaaatccaagtaatagaagcaattgacttcacaacgtttgaaaagatttacactcaattaactccgatgagatttgaacttaagatgaaatgttgcgagttgagaacaaacgtgtatgaagacattttatcagtctttaagcttctgataaacccagatgaaatttttagcttctatcaaatcaatcacactctagttaaaagttcatacgacttgaacagcataatgggtatgattccaatcgagcgaagcatcgccctttcgttagtagagaaggacaataagaaatgacagtactacaacgtccaggttttcctaacttaagcataaagctctatgaaaattacgatgcttggttagataaccgtttccttgaattagcagcaactgtaacgacactcactatgcgcgatggtctttatggaagaaatgaaggaatgctgcaattctatgataacaaaaatatgcataccaaaatgaatggtgaccaaatcattcaaatttctgtggccaatgcaaacagtaaaagaacattgaaccgcatttatggatgcaaacacttttcggtttcggttgactctaaaggcgataacatcatcgcaattcaacttggattggtgcatgagattatcaacctcaaatttagtcgttgtttcttcaacgatgctggagagtcaattaaagagatgattggtgtaatttaccaagacactcctcatattgctccagctataaactcaattaacacttacgttccacgagttccatggacgagtacgttaaaagattatttagcttgggttagagaaatatctcttgctgttgaaagtgaccagttcgtgtttgtgtgggaagatatctatggcatcaacatgatggactacgcgtttatgattgctcaagaacctatcccggttgttgttggtgaacctcgccaaattggccaaatgattaatgaactgaacacagaccttgcttataatttcgagtggcttactaaagctaatcaattcacgcgtaacccaatggctaatgctacattttatgcccacagcttcttggataaccaattccctcgaattattactggcgatggttataactcggttttggtatctcgctcaggttcatattctgaaatgacttatcgtaatgcatatgaagaagctttacgattaggaacaatggcgcaatatgacggttatgctaagtgcactatggttggtaactttgaatatactccaggaaaaaagataaacttctttgaccctaaaaaccaattccgcacaaacttttacgtagatgaagttattcatgaagtttctaacaaccagtcaataactacattatacatgtttactaacggacagaacttaagtccagtagaaccaattaaggtgaaaaatgaatttaaacctaatacttccaatgaaaacaattcaagtgaaccagaaggaaataaaaattcctaagcttggattgaagcatcacaacatgctgaaagaagttaaatctccggaagagaatttatcgctcttgattaattcaattcatccaggtttaacaccagccgaaatcgattacgtttcaattcatttacttgagttcaacggtaagattaaaagtaaggtagtcaaagatgattttgaatatgacctttcaactttaagaattgttcaacgattagaatttcaattcgctggtcatactttcaaattcagagctcctaagcagtttgaaggatttggcggtgttgataagatgctttcaaaatgccttgaaacggtagacggtaaaaaagaagatgtcgacttcatgaagatgccagcatttgtaactaaatgggcagacgacatttcaagtaccgtagcagtaagcggccctaatggcgacatcagaggagttgccaaaatcataggaatttttgaatgaaaaccgaaaacatgaagacgatgcgtcggaaggttattgaagagggtcgtagtgaaagagatgcagcgaaagctgcatcaactcaagccgaatctttatcagttctttcttctcagcttgatgatttacaaactcaagctgagcttacgtctgaagtaattgaggataaaggtaatcaagttattgatgccttgaatcgcgttgaccaaagcataattgatactacagccggagctgaattaaccgccgaagcatctgaaagaactacagaagctgttaagcagcagactgaagtatcaaacaagatttcagataagctcagtaagctaacagaacttttaaatgaacgtctttcagctatcactccgaatcttccacagatatctgttccagatacatcactgtctgtagttgaagatgcagtacctgttgatatagtgacaccagggttaccagaattacttcaggagttaattccggacccggtcaataataccaataaccctaatgatgcgttcttccctaccgttccagagaacccagagagtgattctaaaaagggagctgatgaggaacgtaagaagaaagactctgacactctgagcaatctgcttaaagctacaaaaagcggattcaaagcttcaatgagcattacagacagaatagctggaatgcttttcaagtacactgtaactgctgtgattgaagctgctaaaacagctgcactgttgttctctattgtgcttggcattgatgtcataatgaagcacttcaaatattggtcagacaaattcacttcggatttcgataagttctctagcgaagctggcgaatggggaagcacattagcatctatatttggaacacttgaaaatattcagaagttctgggaagctggagactggtctggattggcggttgcaattgtcaaaggcgtaactgaaatcatttacaacctcagtgaacttatttctcttggaatgtcaaaggtagctgctgctattctttcaattattcctggcttaggagatgctgcattatctgttgaaggagctgcattggaaggtttccaagaaagaacgggtaactctctttctaaagaagaccaagacacattagctaagtatcaatcatctaagattgaaaaaggcgaaaacttcttcgataaagtatctcaaggtaaaacttggattgttaacaaaataactggagatgctaacatttctgattttgttacagatgaagaaagagaatcccagaatgaaaaacttcgtcagatgaaacctgaagaaagggaacaagttctgaagaaagggaatgaagctcgtgctgctattgttagatttgaaaaatacatggaacaaatcaaccctgacgataaacgttcagttgaatcagctgataaagcatatgctaatcttcaaacgcagttaaacgacactgacttgaataattctcctgtaactaaaaaagaattaagtgctcgcatgaatattgttactgctaagtatgataagctcaaaggtaaagaacctcagcctgctccatcgtctcaatctgaggatgttaaaaaagtcgaaagcattgagaagaataaagcggctaaagaggcttcattaggtactagtgctggagctgctgcggctaacttgttcaatacaaataacgtcattaacaacagtagaactataaatactgttagtcctgtaacgagcactaatgctccaggcgtatttggtgcaactggtgttaactaaggaataatcatggctataagagctacagaaattctagataaagatttcggcagtggagaaaagacctctgccggtcaaagttctatttcgtcaactcgaagaagtactatagtagctcaatacccggcacaacgtgccgccggtaacgatgctgcaggagaccttcgtgttcatgacctttataaaaatggattgctttttaccgcatatgatatgagttcaagaacatctccggaccttcgtaatatgcgtcaatcccaattgagtaaatcagcgagttctattcttaatagcctcggaattaaaaataacggccaagttgataaatctccgattgcgaatattttacttccacgttctaaatctgacgttgaatcaacttctcacaagttcaatgacgttggtgaatcattaattactcgtggaaataattcagctactggagtattgagtaacgttgcatccacagcagtatttggtgcattagattcagtcactcaaggtctgatggccgacaataacgagcaaatctataatactgcgcgaagcatgtatgctggagcagataacagaacaaaagtattcacttgggatttgactcctcgttcagtagctgatttagtttcaattattcagatatacgagtgctttaattatttcagctatggcgaaactggcaattcaagttacgctaaagaattaaaaggccaattggatgagtggtacaaaacaactctgctgtctccattaactccagatggagctgatttgaacaacacaatgtttgaaaatatcacttcattcttaagtaacgttattgttgtaactaacccaacggtatggttcatcagaaactttggtaagacatctaaatttgatggaagaaccgagttgtttggtccatgccagattcagagtattcgctttgataaaactccgaatggtcaattcaatggtttagcaattgctcctaatatgccaagcacttttactctggaaattactttccgcgaaatcttgacattaagcagggcatcactttatgcagaaggtttctaatgcttaatttagatgaattcaacaaccaagtaatgaacgttgattttcaacgtacaaatatgtttagttgtgtattcgcaacgactccatctgcaaagtctcaattattgctggaccaattcggtggaatgctttataataacttgccagtctcaggagactggcttggattatctcaaggcgaatttacgcaaggaattacatcaattatcactgcaggtacccaagaactagttcgtaaatcgggcgtatctaagtaccttatcggcgcgatgacaaaccgtgttgttcaatctttattgggagaatttgaagttggtacttatttacttgacttcttcaatatggctttcccaacatcaggattgatgatttattcagctaaaattcctgataacagactgtcacacgaaacagattggcttcataactctccgaatattcgtatcaccggaagagaattggaaccacttacattaagtttccgaatggattctgaagcaagcaactggagagcaatgcaagactgggttaactctgtacaagacccagtcactggattaagagctcttcctatcgatgttgaagctgatattcaagttaacttacatgcacgtaatggattacctcatactgtgtgtatgtttactgggtgtgttccagtttcatgtggttcacctgaatttacttgggacggcgacaaccaaattgctgtatttgatgttcagtttgcttatcgtgttatgcaggtaggtgctgttggccgtcaagcagccgctgattgggttgaagatagacttgttcattctattggaaatatttctgatgacatgagtctggacccatcggtgtcaagactaagtagattaggaggcgctgctggaggtgttactcagatgggtaatgcaatagggcgtaagactggaatgtggaatagtacttccaagatacttggattatgaaaaaagggagccaaaaggctccctttgttttatttgcggaacactacgaaagcatttagaacaacttcagaagattgctcaacgttagttacagtgattttaaacggaacttcaccatcgaatttaccattcagagtataagcaatatacccttcgcatttgtcttctggaattccgaacggtgcaagtggaaccatttcaaccattcctttagcaatcttttgaatctcgttaaagaccatgttgttgaattcgtcagatactggaactacaccttcaactacagtttcttggccattcatacgcagaatcgatttcatgatgttctcctcagttagtgtaagtctatagtaacacacttccatgtgcgtgtaaacggttaaagaacgaacttctctggagtgtcttcaacatcaatcattgaagccaacagagcaagaatcttgttgctttccgatgtctttgtggacttcacaaatccttcaaaatcaaatggacttgattcaggctgaggttcgtcactgtattctaccacttcaccagtttccatcagaacatcgccgtcataaacaacagcttcgtctaattggtcagcagtcattacttcgccttggatgaatttctgattgtcgtacacgagaccatcactataagaagcatctacaatgttgttgactttcaacatggtaccacgaggcagaataacttccatttcacctgacatattacttaagtcgccaggataaaccacgttaactttctcgccaccagtaatagcccaaccaatcatgactcttgtgctttcagcttgctgaacatctttagctgcatgaacctcatcagtaagacctaattcagcataagtcatagaagctaacttgacagtttctgcactgttatctggctgattcaatactgcacgagtattatcagaagccattgcaaccgcttggttacctttccaaccgccaaagataattggagataaagatgttgaaacatagtttctgaaatagaatactctgttcttaaccatagcttcaaaaattggtttacgaactgactgtgaacgccataaggtaagtccttctggaattctgtcaccgcgtttaaatgcatcgtccaaatttttgatagcagtagtaacttctttataagacagtgtatcgtaattgtcagctctataacgacctaaaagcatattgttgatgtctgaataaccggaaccaacatactctttaatgcctcgtttttctgcatttgtatattgaagaggcgtacgagtacgagtaatatcttcaatagtagcagaaacgtttttagcataaccttgaagagctgctttaatcattttggtacgttcaatgttccaaagattgttagccatttgctctttatcttttggctcaaggtattgtggaactttagtcatgatatgttccattgcttcgtgtttacgttcttctaaagagtctaaaagagtttgagtatacgcctgcatactctgaactgaagttaatggagcgttaccaattcttgattcaagttcttttacaaatctctgttcaaatttttcagattggctcaatttaatcgtggttaacgattttaaatggaaaatagcaccagtagctgctaattgagcagaacgagctttagccgctttagattctactgcatccttcaattgctgagcttctggaataggatttgccgttgcgggtttactgaattcggcagcagtagcttcgtatttttcaaattcttctgggtcatgaataatgtcagaagttaaagattgacttgctgctacttgacgacgagataccttagcacgagcaataacagattggtcagtacgtttgtcgttctcttgagcgatagtagctgctaaagcttctgatttagaaacttgtttacctgacttattgttgatgtaaacatcgccaacatcagtatcaaccttggtgaactcttctgttgatatctctgggatgccagggacggttgagaggtcaacattcttacgatgaataagaacatacacgtacttcttatcgtaatcatagagttctttcaggataacaaaacgaccacccagacgactcattaccaaacggttgataatcatctgcactgctcgagcttgtccacccattttgcttttagcaatacggaacatcactgcatccattttgtatttcttcacagtttgagatactaagtcaaacatggtagaaataacacccaatggattaccaccaagatttttcagcttaaccaaggtacctttttcagatacaccaagcacaatagcgtgcatcattttatcgccaggtttaacgttcttgttaacgtcgccaccgccggtgtaagaacacatacgaagagctactgaaccttctggagcagcaattgcaaaaatctgtggaattttagttttcggataaagattagtgaccggaagcatttctgaatccgcgtcaaaaacctcatttaattgaaattcggtcattatgagtcctctattgtttcttatatttatagacaattaaagccccgaagggcttagactgcaataatattcctgaagatttcaacttttccgccaccacgagtagcaataacctcgtgtttgttgattcctgaaactcgaccatctgtaaatgattctacttcaccttgcgggcggaatggtaattcgaccaagctctgtgttacattagcggctcgtcctgagccttcacctgggtgagcaattgtgataatctctaaatagaatttcatagaccagtaacctcatggaaatcgccccaaatatcagcgaacgtatttgctacatctttatcacgacgcattttaatcgcaataggcaagaacagtttgacataatccgttcgaccttcagcagctaaccagccattacattcggattcaagaataccaccgatgtattcatttttattgagccaaatgcgagtacggtctaactcgtgccaatctgaaattttgtctttaagacctgaaccagctttaactttaatcagaccacattctgattcaagataaaaaccaccggctttgccgggttgtttactatgctcatagatatcaacaatgcgaaggtcaatcgtaataacttctttgaacttataaaggtttttagaacgagtgttttcccagaaagcaccaatgttcttcaggataataccttcaagaccttcatcaacatatttgcgataaatgaccttggcttcatcaagattatgaacgatgtggttctcaatcagaatcatctgagagtaacctttaaccatcagttctaatgcacggaagcgaacatcatacgcaaatccagattctttaccttcggaataaacaacatccaacggaacgtaatcccatacctggaatttcataccagcagcttctttagctgagatagttcctttcagagatttattggccaacccgtttgacattgtacgggattcttctttgaattccttagctttactcagctcgggtaaatcaccgaagatatcgtccaatggaccagctgggagagtgcttgcatgatagacgagttcaccatcaatcattacaccgccaggatgacgttcacgagattctttggtcatttcaatgagttgttgttttaacaaatcaagaccaagatactcgttacccgctcgggacagaatttttacatcatctaattcatcgccacgaacttcagcaaatgctcgggcaccatcagccttaagctgtgcaaatgcagggaacttaatgttcttttcaatacctttttcatcataagatgaagcaagcatctgtggctgttcaggaattagatttttccatactttattcgcaatactacgggatgcgccacagcgcaaatcacgaagcagaactttcttaagtacttctacatcagcttcatttaggtctgcaatataacttgccaattcagcaatagcagcgttgcctgtaatttcacgagcagctaatttaaattccaagaaatctaaagcatcatctaattttaataaaccaaagctttgagtgcgttctccggcttctggccatttcttgatgtaatactggagcttaccatcataagtcattctgaatactcgcttcaaaagctcattatctttatgacgacgaatgatagcttctttttcttttgtagagccaattgaagcaatttcattgataatatctaaaatcatattcacctcgtttattgtcccgagcgggtatgacaattatatcataccctttgtaaagctattgaccgcgatactcacgaatgagttcagccaaagttcgatggtaaagtactccaccatttttacgagtaatgtagattgcgccattgaacatcgcatcaatcatttcacgttgcttttgattatcagcatgaatgtttcgcgccttgaagaactcttccttgtttgcgaaactttcaatacgcttggttgtgtctgtttgcgggaaccattcaattacgttaatcatgctttacctatagtagttttagctgtaggctgacgattcagatattcgatacctgtcccaattccgtatcctacacctggattgtaaacaggaagattacctggatgctcataccacggcttataatcagaaggacctggatttacccatttctttggaaattctggaaacttatcaaatggccaattcggagtagtcttttcaacctttttgaataagtcgctcagcttatcaccaaggctttcctggaattcgcgctgattcatcagacgctgaacatgttcccagttatgcaccttttctccatatttagaggaggtgtctcgctgaccgcgaggcataaacatgcaattgacttcaccgccaaagacttcataagctgaatctacgtgatgaggaaggtcatcaatataagcaacaactcggtcaccgtacttctctttgattttctcgaagagcttggtttttggctcagagtggtcgcagacgaaagtttcaaggaaagcacctgggaacaaagcgttcaagttgaattgacgattcagtttagcatcaacagaagtaccaagcgcagtaaccgcaacgaagtcatacttatctttcaatgcattgacaactttcaaagcatcgtcgtatgctgccagatagcgaatgaaatctgagcaattatatttgaccatcagctgttgagcaaattcttcgtctacaccaaacagatcttttggcgcaacgaattggtcatcaataatcatttcaagaatgtggtgaacaggcagattgtacttctgagcgaagtaaggcaagcctgattgccactttactaatacaccgtctacatcagtagagataattggtttatttgacatttttagccttcattttagcaatcatgtaagccgcgatacaagatttacccggcagtgatggttgtccaactccacttaatagagtagttaactctcctactttaataccgccttgatttaagcgttttaaaacatcaagacctttcatatcatatttgacttgcataacattttctcaaaggttgcgatactgttagctgggccacttagagttatctctatgaacccaggctggcttgaaggaccaattctgtatatacatatggctaatgttcttgcgtattccagaatgtccttcgttaaccctcttacattaaactgtttcataaacttcgtcattagcagctttaagaggttcaatttcacattctaaacgaatatcagtattcccgtcaacccattgtacttcataagccggttgaacaccatattctgggattgcttcagcagtatcacagatgactcccggaataccgcctttgcgcagctgtacgggttgtaaaatgcggtatttcattctgccaccgcataagttggaatttgatgaaagaaatcagggcattcaagctgatacttgacttctgtatcagagacagttacacccagcacttcaatcattggattgctcaacatgccgcgttcaaattcaggtgctttattacgaggaatagtgataatcattacagagtctccaatacagttttaactttagcttcagcaacttgtttaacaaccagaacacgaacaccttcaactgcattacgaatttgcttttgagctttttcgttagcttcctcttcagtgtaaggaccaacgcagaaaggctgttgcgagcgattagttggaatagtcatcatccagaaatcttttgcatcagactctgttggtttaacttcttcaaggtacttgtgaacatcagtagccaagaagaagcaccatactatattgaatacaccaacattagcatgatgaagtttaccatcaacatcgattgcaatgatatttccaccactatcaacctttttgactgtgaatggagttagtccattattcaacagcttaagaagttcttcagaataagaacttccgcgatttttaagactaacaataccagtttcagtcagcttaaactctttatcaacaatactcataactatttcctcaagtagagggcccgaaggccctaaatttagattacgaattcgtttgaaacgatatcccaaattgcttcacgttgttcttcagttgttttctgaccaagaacatgacgcagataaagtttaaccagaagtttgcgattgtctccgttccaagaaggatgagttcctaaatcgcgtttacgatggtcatcatgaaaaccaacagaaatgactgaacctttgagtttaacatctaaagttgggccattttcaaaactgatgaagacgtagttatcttcccagtacatatcgatttgagcaactgtgccatttttatgttcccagagtaaagttgttgaaacgtcccatgcattatcttgaacgtatttctttttgaagttagtgtaatccattttgttctccgttgtatctgtttgtttattgagtttatatactaacacatacaacggaggatgtaaacggtttagttcacttctgtgaaaattgtttgaggaacgtactcggttttggcagttgcaatcatcttcataatgatagctttaccttcaatgtttttacgcaagaacgacttgcacgcatcatgagcttcttcggacgtcataagaatagctatggaacgctcgtcccctacttggtccagattcaaccaaacgttttctttcttagtctggcctaaagctacatacatcacttcaacggtcttttcttcaacctcaaccaggaaatttctgacttcagtgccggtgaaccaaggacatgaatcaccattcataccgtcaatttcagcaccttttggactaatccaaccttcattttcaaatcggataagacctacagaaccacttgcaatagcttcgccttttgcaatgtaaaaagacttatcaccgatatactcagcaataagctgattcactctctgattacagccttcagcggattttaaaaagccttctttttctaagcggtacagaacatcacttttcatagtttcctcataaggcccgaaggcctagaacattttacgttcggtccagttatcaagattaactgtaccagttttcttcattttttcaatcaagttatctgcgcgagtgcgtccattttcataccacactacatcttcagaataaccatcttcgtcttcataagtttcagaacgaatatgaccatgaatgcttgttttcaaaacgtattcagtgccagtgaaccagttagtcagaacaatgtaccagcagaaatcagtagatggaccttcaggagtcatgcagtgaactacatctccttgccacgaagacagatgccacattggctcttctacttcgattgctttgtatccatcgtggtctttcgttttgatagtagcattcagattaattgtgttcattttattctccgttaccatattggttattgagattctatcataacacaacttttgtcagatgtaaacggttagagtttttcgcaactatggtattcagcatctgcccaaacaccgaatgccggcaatgattctagcattgagtttccaacttcaattgggtcttcccacggccaaagtgtagcaatcttttcatagaaaaagactgaatccatatgtgaatattctgcagggtattctgatataactttgaaaataaatttacgtttaaacatatgaacctctggatacaaaaaagggactcccgaaggagtcccgaacttatgctttatgctttcttacgtggattaccaaatgcagcatcatgagcaataactttgcgagcgcgagatgctagctggtcagccaatggattaatacgagagttagacccacgcttgtagccagcgcgtttagaggtaccaacaacttcttttactgcagtttttgctttagtttgtttagccatttttagtcttccattttggagaaatacatgggagcacgttcttccgagtttcaacttctttcgacagttctttcggttgtagctcccgcaagccctcaaagggtactttgtgagttttgtatatttaacgttccggttctcacaaccttaactacatacgctcttatctgttgcacaccgttagctttaagggtccgggtctgattactcagggataagatatacactgatggatgtataggccttgaggcgtactcccgattagccatcacctcggggtagcatgcacttgccgcttaacttgccttacggcaacattacttcaaggtcactacgaaatgacgaaccgctttacgagctgctgaacacagaggtttagcaaacttcagctcatctttcagagcaagtacatcgcggaggtctgcctgaacaggattcagatgtttgaaacctttcagaacttccagtgcttcggcgtaaacgtcgattgatgcaccgtagttatcgtgacctgcattccaggagttgcgctgcagatgcagagcgtgttcaagttgtttgttcattgacattatgtcattcctcaaatgaggttaaaaatttgatgcagagcccaaactcattaaagatgagatgcatcgcttagaagaaaacatgtcatgtccttttggaggtagttctcatgttcttcacaattttatttatatcacccgtagatgcacggaattgacttccaatgacaagtaacaaatttctgtgcaatttcttttggttttttcataccagcagcgacaagcggatgaggtacattacgaatctgaccagttggcagcggcactaacataccgacttcgaaaataccttcaggaacatccgcgccgattgaatagatttcacacatatcagggatttgtccagtttcttgtttgccgataacaataccgccagaagaaacgatttcatcaccttgctgaggaggttcagaaaccaagataacatgttcgccgatagctttaattggtaaatccattgttacaccttgttgtttgagcatgaaataatattatcatgctcatatttaagcaattaacctttaacctgaaccagtttcagcagatgctctactttaacaccatttactgaaacgatagaatctagtttgaatgaacgccatgcgtgtttttcagtgtcccataccggaatagcttcggtagattctttacgagacacctgagagccaacgctttcaaccaagtcgcttggaatgatgtcatggtcacgagtacaacgcagagaacggatagtaccatctactttctcaaatactacttgagattcgccacgagccagaattggtttcagagtatcacgaatttgtactttttcagcttcagtcagtttagttttcttagtcattttcaacaccacagtagttttcaacattataccaattgagtttgttcaagttcgtcttaggaacatgatgaatctcaataccagcatcgcggaggatgttatcccaaccgtcgacatttttatcgtatgtttcacaatatacgagtttcttaattccagattgagcaatagctttggcgcagtctgggcatggtgaaagtgtaacgtacatcgtagcgccttcaattgaagaaccattacgtgctgcgaacagaatagcattcaactcagcatgtatttcgttaattttcgaccactcagaatgctcagctcggaatttagtgtctaatccatattttggaattggaccatcttgacgaagaccagttccgggtttcttaactaaccaccctttatcttcggcatggtcgcaacagttaactccaccagcaggagaaccattatatccggtagaaatgatacgaccatttttctcaataactgcaccgactttccatgagcagcatttcgattcttgggaaatcagataagcgatttgaagtaccgttgaagctttcattattgaataaccaaatagtttgaacggttagttttaatcagcgtgatttcagtatgaagaggaataatctcttgtaccgtaccagtgattataaacaccccatctttaaagcgtttctttccatcgaagaaaacatcgccacaaaaacgttcacctacgacaggagaagtctggtcttttgaagtgataaggattccatcataccctacacaagaattcaccagacggtcacacgctaacacagaacgaatgaatccaacaccatcttcagtgaattgagatttatcaccacaagcgttgtaatgttcttttcggacaccattgaagatgtcagttaaattcatcaaattatatcacctaaaacgttagtcattgtaacatgcccatgacggtcaagagttaacaaagatgtctggtcctttccgttatgagtgattgtaattaaagctccattagaaacgcggtcgggacggagctgaacctcagctcctggtactttatttgctaaagcctgcgcgaattctttaagcttttccagaaattcaatccggctaaaagttttatcagaagtcactgttgtcccagctgtaaattacagagaagaaaatagggtcatctttatcaatgtctaaacggaaatcaaaagtcattgaatagctattgaaagatggcgtaactttaaattcaagattcttccaaagaatttgtaaagcacctacgatatctgcatgaatttgcgcataagttggtgctgttgccggaacaaacagataattgtctgcaacctgagctacaacaacttcagccactttacgaaaacttgaaagacctggacgtacttcagtatgaattcccattagtgcaccgtgtgtactttaacgttaacgacaaagtgagtaataacctcaccaattggaacgaactctacataatactcatctttgtatcgagagttcatatcggtgcgaatttgagcaagcttattaatgagctcaggtgtcatattcataccgactatttcacgaagaagcttgtaagcttcctctttaacctgttcgtgtttattatacatcatttcaccttatgcattatcgacgatgccacgggagcatgagcttagttttcttgacagtataacttctttcaggattagctgctcgaacttttaagcatgtttcccaagcagcaccttcttcgccatatacgcaataatgattatcaaatataactacgcaaccggtgctgctattaatgatagcccaacattcatgataacccatcagaaatctccatgagcaacttgccagcattcaacaccgatacgacgccacatttcaactacttgtgctcggtcatctactgcaagtttaatgttgtaatgaggagcaatatcacgccagaaaatttcttcttttacgatatcatctttacgagaatcaccctgcttacgttgccaatgtccatgagtttcaccgacgtggtctaatacccatttctgagtcatacgacgataaacagtttcatcttctttagtgccagattcgcgtccagacacagtaagaattttaaaacctttctgacgaagcattttcagcaattcaataaccatttcttttggagtatcttcaccacatttatcgagatcaaatggcgaacgatgatggttatcagccaatgttccatcgagatcaaagataactgccttcggcttagacaagtcaggaacataaactttctcaacttccattagcgtatagaaatgacgcagaacatcaatcggaactgctttatctccacgatattggttgcgcttaagcaattcagtccaaggaacatggaaatcctggaaagacatttcatacaaacctttgaaacgaagttcccatttctcaaccgttttaggattcaagttagtgtcacaaacgataacaccctttgtatgttccaggtcaagcagagatactgcggcagaaatttgagctgctgttacagcacgttctttgtgcttagaatatttgtatgcattacgagcatcaagtccaaacagtttctcacggaagtcatcacgagacagaatataccaaccaggatttttagcaacatattcattagcccaagttgatttaccacaacctggagcaccacgagtcaaaataatctttttcattctttactttccaactgtttagccattgtaataagaaattcacgacgcattttaataacagcttcttgaacttttgtattttcacccttttcggctttaatagctaatctaatattagcttcatcgtattcgcaaagagctactaaaaactgccgcatgtattcactcattcaagttcctttacgaagttatcaacatcagccttagctttattataatcagctagagttttagctaaccattcttctttgcggcctttaagcaaagcagacaaatatgaaccctgagcaaatagctgtgtagtcattaaatttgacatagcatttgctagttctggcgctttagcttttacggcacgtcgtaaatttgctccagcttcatctaagtctatggcaatgttttcaagttcttgctctgcgcgaactgaaccatcatctacacgaagtccatacgaataagcatatgaagctttgcggtatttttcaagtagaattttaatggacattagcaatttcctcgataatgacattcacccgtgcataagcttcatcatatcgagctttagcttgtattgcttcagtagccaggtcttcataagtcaaataaccatcttctaattgcatacgagtctttgctgaaccgtattcaattgcacgagctttaagttcagagatggctccttcgagagccattttagcaaatttgttcatagtccaagcgcctcatataaagatttgcggatttcacgaacgtctttaccaactggacgcattgcgccttcaacatctgagataaagccattagcacaattggatttaacttgtccgtaaattgaagcagcttcaataagcttatcaatcaaatcacgtttataatcttcttccatacggattccataccattcatcgtaatcttctataggagcaaagattttgaaccaagtttcttctgaaatataagtttgttctttaagtttaaagacgtgagatgggatagtttcagttcctggagcaaaaactctaactgaaactactgttggttttccattaatgatttcaaaccaaggactcacagtggctttacgcattaatggagttttgtgacgggcgccctgcatacacaatttgcgcaactgggtctttttaattgcagataagaatgaaccatcttttacaaagtagcgcataatatattcctcaaagttttattatccgatgaggccctaaggcctcaattaaaacgtaacaaccattgcaagagctactgtgcaagcaactgcagcaataaacaatccgaaacaaaacagctttgcacctaacgtgaatttacgcattttggttcctttaattcagagcgataataacatatcataccattagcatctttggtataacgaagaacatcatctaaccaaactctaaattcttgtgattcagagaaaggcattcctacaaatggtcgtccgtcaacttcaacgatagtccagcggccattccaaggcttaatctggtcaggccaagatggatgcactactgttggctggggtaactctggtgacttctgagaacatccagacaatagtccaattgataatattacggctactaaaagtttcacttagtggcctcctggaactctagagtcaatttattaaaagactcatttaattgtttttcaaccaacttaggcttagcttttactacattctcacgcttagcatctttagccattttagcgctagacttatcagcttctgctctatttgctttacgagtctcgtcatatttgttgagattcacaaagtcggtttttaacttttcaatagctttgccgttagcttcagctatttgttgcatttgcttaaggtcttcttttaagccatcaatccgtgaagattgatattgaatgaacccataagctgttaatccgagcgccactaaaatgacgtggatgtttgttattttgaacataatttgatgattgcctgtacaatatcgtcctgagaaagaccattgataagaatatgatgttcagcaggagagttttgaattttgaagcaagggtccaccatctctgccatttctgaagcagacagacgaggattagaaacacccagacgatgctttccatagattgggtctacgatgatgtagcacttacaaccatttacatgaacgtttggttgggaaatgttaatcatcacttctgcaccgtacttggtcagatgattatctaagaagctgcgcatttcttctactgcttcaggcatcttctcagcgcgttcttcatttacgcggttactatattctttacgagccttttgacgcttttggtcgcgagagtaagctacacgtaaatctgtgatgtaacccagaggacgagaatttttgaaaatacgaatcccgtcatgatgagtgccaccgtaaatttctattagttcttcagcagtgattaagttcagcatttcgttttctccatttggttagtgtagagacatagtaacacaaccaaatggagatgtaaacggttagatgtacttagccggagtgaatggctttgtgttcttcaagaatgctgtgttcagcttcgtgatgagctgatcgtcatcaaggtctcctgcatacattttcatgatgataccgaaaatctgaggcagaccagccagtgctgtttcagcttgagcatttgctgcataagtcttacgatctttaccacgatgagtagcgtagaagtcttggcacagtttaagagctgaacgaagatagtctaagtactgagtttcaaaggcattaatcttatcgatagctactttatcattatcaaacatgccacgaaggtcatcagcagcattgttcacgatgcattcaaacagacgttggttgttgataatagaatcctttgtatgatggagagcacaataccattctgttttcagtttgaaacgaagaccatcttccattacgcaaacataaccttcaatttgttcttcagcacgaatcttggaaacgaaatctccattaggaacttcaaatgcttctaccagatacttacgaagaactggatgcgccaaaaggtcttcgtaatcaatgtactcacctgtgtcattttcgcgaacgttcagaagaataagcatcttttcatggtagttcagaacaattcggttttgtggagaacagtattcaaagttagcagtgaaaccatcttttgctaaatcaatcagagcttcagccaaatccagatgatcgatacttgctagcatagcagaagcttcaacagcctgctcagatttgatagaagtcttagacttaaagcgaatacgattttcaccgtccaaataagtagaaaccaaggagccatcttctttggctaacatatacttaatcttagaaaggtccagattcatagtgaatggagtttcattaagattgaagaacttttccattggacgagatgcgatacgcaccggggtatcgtctgcatcaagttcaaacataatgccacgacactctaatgcagacggcaggagccagtcagagtaagatgcgtaatggtaagaaaacgtgcgatatttgtaccccattggagatacatcatcacggtagaagaaacgagtttcatcgttacatagagtcatgagctcattgaataattttttcactttttacccttatgttgagtattccaaggcggatttaatttctttatgaaaagcggctcctcaaggtccatcgttgagattgacatttcaccgagttcattgtttatcaggagattaaagcactgtcgagcatagaagctaacagtctttcctgacatcagagcatcgtaaatctttgctgatttagttgaatctgatgtctggtctttgcgattaatcgctgtcctgtaataatttattctctttctgagattcttggtcttaccgatgtagaccaactcattatcaactgctattgcataaaccacattcaacttgtttggaacttggacgtggtctatcgtacaatccggtagcagcttcagttgagtgtattctataaaagaaaactcgttagcaatatctttcataacagaagggcccaaaggccctctccttacaaatactttctgaatttcagcaacacatcagcatcgacatcgttgtcaatctgagctacaaggtaacttgagatttcaacttcttgtggagcagattgtactgcatctgagtttaagtattcacgaatccatgggattgggtgacgaacaggagcgtcagtaatcgggcatggaagaccgcagctacgcatacgtgaaacagtcagatagtcaatgaagtcatgaaggattttcactgaaagaccaggaactccaccgtcacgccacagatgaatagcccattctttttcttggcggttgatttccatgaagatatcaactgcttcttgttcgcatccacgagcaatctcaacccattcttcaccgtcagtaccgagctgaagctggcggataatgtactgtgtgcctttcagatgaagctgttcatcacgagcaatgaacttcataattttggagttaccttccatgatttccatgttcttatggaagttgaaggtacacgcaaaagatacataaaaacgaattgcttcaagaccattgatgacatgcagacacagataaagtgctttcatcaatgaacgttttttagaagctagatattctttagccgattctaattgttctgctgcttcagaatacccgtcgtaatctacaccgtttcttgaaatagcatctacttcgccttgccagtattttacttcttctttagcattttcccaaagacgagtcttagttgtaacgctatcataataacgaccaattgtctcagctcgtttcatgattgcttcatcgagaacaatctcatcaaacaccttcgccgggtcattcagcaagttacgcatgatgtgagtgtatgaacgagagtgaatcgtttcagagaacgtccaggtctggttccatgtatcgagtgatgggtcagaaatcagagcagaaagaacagcagctggagctcgtccttggattgaatccaacagactttgatatttcaggttatcaaggaatacattttgctggccaactggaagcttttcaaattgagctcggtcagtcatcaggttaacttcttcaggccgccagaagaatgagagttgtttctcaatcagttcttcaaatgtacggtgacgctgaatatcatatcgtgcaataccaagcccacttccgaagaacattggctcggtcatcaaatctacttgttgcgtattaaaaactgtgctcattatttacctcttagggaccatccgtggtccaattataaactgaaagaattaaagcttacatgcagaacaatcttcggtttttggtttttcgatttcaaaatcatcgttaccggaaccatcacgagtgttatgatagtacaacgtcttaccaccaaagtaccagaagtaaagcaggtcgtccatcataacagacatcggcactttacctttctcataattctgagggtcataataagtgttagcagatgcagattgacatacccacttcagcatgatagctacttgagtcaggtaaggcttgttgccttgtttagcaagtttccatgcataatcatagaggtcagcattcaattcaacgtttggaactacttggttaaagcttccttctttagactctttaatagagactggacctcttggcggctcaataccgtttgtgctgttggaaacttgggaggaggactcacatggcatgagtgcggacagtgtactgttacggatgccatattgcttgagttctgcacggagtgcttcccagtcacaaacgtaattcggggccgcgagctggtcaattctcttattgtaccagtcgataggtaattcgcctcgagaccaacgagtgtctttataatactcgcaaggtcctttttcttttgcaagtttaattgatgctttgatgagtgcatattgcagcctttcaaacagttcatgagtcaggtcatttgcatcagcgtatgtagcaaagttatctgctaaccaagcagcgtagttcgttacaccaacacccaatgctcgacgtttaagagctttcagagcttctttaaccggataaccttgataactcaagaggttgtcgagtgctcggacttggacttctgcgagctcgttaatagtttcttggtcttgccaatcgaagttgccgagcacgaacgcagacaacgtacacagcgcaatttctgcgtcttctgagtagacgtctttagtaggtaacgcaatttctgcgcagaggttcgattgcttaatcgtagccacatcacgaataaaaggaccataattaccaacgttatctacgaagtaagggtaaattcgagcagtgcctgaacgctcagttaagaataactcaatcagttcacgagctttgacacgcttcttacgaacatcagggttcttttcaagagcttcatattgttcacggaacgcagcagcatctttgaaatagttctcgtaaagacgaccagcatcaatatctggagagaacagagtgatgtaatcatctttaatcagacgttcaaacatcaggtcattgatttgaacaccataatctaaatgacgaatacggttttcatctacacctttgttgttcttaagtacgaggaggttttcaacttccaagtgccagattggatagtacaatgtcgccgccccgccgcgaactccaccctgggagcaggacttaactgctgtttggatgtgtttccagaaaggaataactccagtatgcttgacttctccgaagccgatttttgagccttctgcacgaatcatacctgcattaatgccgataccagcacgtttagagatatactctacaattgattcagcggatttgttaattgacttcagtgaatcaccggcttcaataacaacacaagagctgaattgacgagtaggagtacgagcacctgccataataggagtaggcagagagattttcttagttgacacggcatcgtaaaaacgaatagtgttcactaaacggttttcaccatcatcctgatgcagagtcataccgataagcatgaatgcaaattgaggagtttcgatgatttgaccagtgctgcggtctttgaccaggtatttttcaatgagttgcatcgtaccagcatacgtcatttcaaaatcacggtcatgaacaattttactttcaagcagagcaatttcttcagcagaccatttggcaagaatttctttgtcgtatttgttgtgattaacaccaaatgaaatctggtcaataaatgaacgaggctcaaactgtccataaacttgcttacgaagattgaacatcgccagattacttgctacatattgataatctggttcttcaattgaaatcattgaagctgcaactttagtagctgcgcgttgaatgtcataagttgtcattccatcttgtagatgcggaacgatagcttgatatagctcatatgggtcaactcgggtgttttcacaaccccattccagaactttgataagtttttctggagtaaattcctgagaggtaccactggacttaattactttcatgcaaatcctctagcgtaaatgtgtctttgaatagtctgtttactatatgagctattatatcaccatggcaagctttaggtttacaagtgcatcctaatctcattccacggagggtctccaagtgctcacgttttatttcaccactcctaatacgcttaatgaagtcctctttaaaggcttcaatggcagcctcacggctgccagcatttttaccaacgtcattaccccacattgtacctcgttggatattaacgtcgaaatcggaatggtatttattaaccactcgacaagctctcatattttttccattctgggaaactatctgattttattctattacgtaaagttgaatagcttatttctagttctcttgaagcctcttgagcactattataaacaatcccattaattaacacctttttacaattaggtggagctttgtttgggtctacttcagctttaacaaatttgtaatttttgctttttgaaatcttttctcctctagagatattagtcgatttcatcccttttgatatagattttccccattcttcgtgatcagagttatcccacgctgattttaatccagtggctcttttagcataaatttcttctttgttactcatagcagaaatgatgtctccaccatctcctccaccagcaatgttatatcctacattaatatcagttgagttaaaacacttaatgaagaatttctctaaataatcgagggtgtgtttatcattagctttgttggataagatttcttttgtgaaagatttcttaccatacttagacatggctcttttaataagagtgccggacccataataattagggtccgaatttttatttttgcctatgtatattttgccatttgataaacaagtagtcaaatatacgtccattagatagccatttttccttttatagcagaatgagatttatagttaactagtttgaaattatcaatctttgcaaaattattaacccaggcaagttgtgaagacgtttcccattcaccaaatttatcaggtgtttcaattttcagttcacagagttccagagggttcctctggagaatttcttcacattgtttaatatgattcatatagatatgagtattaccaccagtgaacaccagatgacctggttttaaccctgtcattttagctacaagatgaattaaagccgcgtatgatgcaatattaaatggcaaacccaagaaaacatcgacgctgcgttgataccactggaggtctaaatatccatcgcgaacgttaaattggtaaagtaagtgacatggtggaagcgccatcttagggatgtctagagggttccaggcagtcacaatttgacgacggtcattaggtagttctttaattcggtcaataaccaaagtcaattggtcaacacccataaagtctcgccactgcttaccataaaccgggccaagctcaccatcaacgtatcccattgaacgagcttgattttcgtagttgtcgtcccagacagttttaccatttgttggagacccatgctgacgaagacgcaaatcgtttacatttgttgaaccagacaagaaccacaaaagttctgcaatacatgctttccaggcaagcttcttagtagttactgctggaaaaccttgttgcaaatcaaaacgaagctgagtgccaaacacagcacaagtgccggttcctgtgcggtcatcagtcacgtaaccttcatcaaagatatgctgaattagctgttgatattgtttcattattttcctgggcgaaagaagatttcacggccttgtttatcaaaccgaccaaaaacagtcatcgtattaccagtgatgactacattacctttagcaatatgatgaattgtttgacgagtgttcatcataattttaacacctaatccgcgagcaattctgatgccttcatcagctgcccaagtgtcattgatttctacatcaatacgatacaagccatgaggaattgttttgtataactcaggctttcgcttatattgctcaatagtaggagcattaccctcgattactaaagcccagtttttctgggcctcttcttgtagtaatgtcaaatgattattgattttcatattgttcttccaaaggattgaagaatacctgacttccacttttaaagaagtctccaatcattgtaacatagccatttgaaaagctaacattaccattcattgaagcaagtagtactgatttcattgaacgacaaagttcaattgggttatttccattgctatcatagatagtgtactctgcattacgatactctctgatatcttcaatcgcaaaggataactcatacacaccatgaactttattccagtttttccacttcttctgagttttgtacgtctccagcagacgaagattataccctttcatagattgtctccgtcagagaagtaagttcatcacaacgaacccaagaagtttctaccatttggaagtcattagaccatgaagggaatacaatgaaactcacatccagagtgacatcagaattaacacggtgtttcttctgtattgacgtttggactatacggtctgcgtatggctgagccgtctctagaatccccttaccaccaataacagaatattttaagccatggctaaaagctattgagctactataagatgtagcaccagtcatgatatctccacccaagaacccaatgaattctgtcatgctaacataagcatcagcgaagaagccatttttagcggttacaagaggacgattcatatcttgaactacaatagattttcgtccaggaagaggctcatcaaaactcataaaagttttagcacccatgatgagaacagtatctttggtgtgctttgcaaagttttgcatgtcacgttttatgtgaccccacggcagaccatcttttagaccaaaagcatattcgttttggccatcaacagtctttgttccacaataagcataaacgagttgtagcattatgatttcctacatttgatgagtgcgttataaagacggcgagtgaattcaatgttagcttcacgaccaatacgagataagaagtttttagtcatatcgtcatatgattgctttaagccagtggtaatcttatcgacggcttcattatatccgtctttatgagcttttgctttggcttcttcaaactcttcaagagtcattgtgatttgcattatccttgcctcattccgcatttaaaacatttaccacctagtgaccacagcccagcgccgcaatacttgcattcccagtcagaaagaatttttatcatgaccgctcgccttaaccaaattacggagagttttcattccaccttcaacagctgcagcaagttcttcaaatgcaggcttagtgaaaatgaatgcggcacctactttctgacgctttagataaccattgatgacttggtcatcaagcggaaacgtaccgtaaccagtctcaattacaccgttaactttgttgccacgcgagtgcgggtcaaactccatcgtaatccatgaaacaccaggaaaattctcgaattgacaacgtactttaactttaggatagccaattacgtggaagctagatttagacattattttggttcctttttagcaattttccaggcagctttgaaagcttcgacttcagaaatttcaatccaaaaaccactaccaaagccatcgctatagcagggacagccatcgcagtaattgtcccaagtaagtaccagaccatcaccacgaacagcaccagtttccatttcgcgaagacggtcttcagcagcttcaatagcttccgggtcgttcccttcgatgataaagtaccacttgccattgtattcacttccgagtttaattgattgacgttgaagtttcattttattctcctttgttttgatagggctatagtaacacaccatagccctgatgtaaacggttagtcgtctacttttagtaactttttgaaagcttcaaacgattgcatgtgctttgattcaacatacacatgcttaaccattttaccttcaagtgagaacacttcaactaccaagtcatagcactcgtcttcaacaagacttatgcatttcggagtagaagctttgtcaaacaactgaaccaagttgttgccagcccagatgtttttgctgccgtcatagctataatcttcagaaagaacataaaacattttaatctccaaagggcccgaaggccctaaaatttacggttcaagatattcaagttgtgactgaacatcttcttcgtcatagcagtagtcacggcgcagatagttggtgatgtcttcaactgtgcctttaagttcaatgattggccaaccaccaccaggaccttctgggttgataactttaagctcaatatctaaaccaagttcgctgaatttgctgccgtcatcaaaaagaagatcaactttttcgccttcaatgatttcgcaaacgatgtcaagttgtaacttagccatgatattttcctttcactctgttgttttgatagtgctataatataacaaactgatgttgatgtaaacggttaattttcaatttctgcaattgtttcttctgcaaaatcaaggtgagcgccaacgcagtatgattcacgaaggaaacgttcaattttctcacgaggaccgaatactttatattcccagccccattcgacagaatctactgctgtacactctaaaccgaattttttaacttcactttcgaagtgttcttcatctgcaacgccgagatagatatgtgccattttcttttactccattaggttggtatgagagtatagtaacacagcttaaagcggatgtaaacggcagaattaacgtaacgtaaaagttactttaggtgggaattgggatgttaatgtaacgtataagttacttggttcaaaaacaacaaaaggagcccgaaggctccttctttttattacagaccgttcagcaattcgtcgaggtcttcatcaccgctggaggcagaaccgccagtttccatgaagtcttcagctggtgctgatttctgagaacctgcgttgaagttcgcgaggtcatcttcaaagttgtccaggtcttcaccaactttatcagcctgagcagaagcgcgagacgcggcagtacccatagcagctgtacccataacctgaaggaatttcttctggttatcttcgaaagatttgaactggtctttcgcagtcagagtagtcaggtcgaccatttgttcctgcagttgtgcctgataagcttcatcttcgatattaggaatctcagattggccaaggaacttggattcatcgtagttgctgaaaccagatactttcttaactttcagaacgaagttagcaccttcaaacgcacaagttacgtcgattggagtttcgcccatttcaacatcaacggcaaccattgcattgattttgtcccaaattttcttaccgaaacgatatttgaagactttaccttcgttttctggagcagcagggtctttaacaaccaggatgttcgcgtagtaagaagttttgcgtttcaacagcttgtattcttcattgttggtgttatatgaatcattcttggacagatattgacatactgggcaagaatcataatcaccgtgggtagaagtacagttttcaatgtaccatttaccacctttcttgaagccgtgattcactagaacagcgaatggtacgccttcatcacctttacctggcaggaaacggatgaccgcttgaccgttaccagcattatccaacttcagtttccattcacctttatcttcggaattaaaacctttagaaccagacagggaagccagttgggaagccagggcagcaggatttttacgcttaaacatagattttaccttaatatttacagtttttgacagtttttatgaacagttgttttgcttcttcgcggtcaacattaagtatctttcgatacgcatgtaactttgtagagtagtttgaccagaccagattatcggttgcttggtcatgtttatttataatgtccagaaacgagtccagaattataaaagtctcgaaagagatgatattactttgaagtaatttgaatatgtatgacgagttaaccttatcattataatcaaataactcattaagcgatttaacttcaactttcttgctgaaatagtaaatattgcgaacgtcttcttcgaagttcgacttgattaatttcagcttaccgatatattcacgataaaacactaacgcatctgcatcggaaatttcaccaatccaagcgtcctggttagctaccaggttactgatgaatatcaaggtcaattcttttaatgtgtacttctcagataacttcttgaagaagtatttgtcacgacgtttatcgtaagccttatctgatactcgcatgcaccagttgtacttgacaacatcatatcgaccgttgaagtgattcttcaacatcaagtacaacttgtacacagacttaccgtcgatatatcgtccaccatttggtggcatgcgcaatttaatcataacaggaaatcgagtgtatttgtcttttgctgtttactaaaggatggacgcaataaattatcgtctaatgcttcgctcataatcttttcaattatattaccaggaatatatttagcgaatgcagtttcagggaaagaattttcttctaaccaatgtgtagcagcttcaagataactcattccatgttcattaactaaagcttcgatagcgaagccattgttctgtttatctactaatgtagtaacagaatccggcttttcagccggagtttcatcatttagggaaaacagtgtcatacagctcaatcgcctcttcagtttcggcttcaaattcatcacgagcagatttgaagtacagagtcagcagtcggttaaacatcttaccgtcaacgccaagttcatctttagcgcggtcacgaatgtctttgattagaacctggaaaccagagattttcagtttatgatcagcagcttcaacaattagtttcttgaggtcagcaccatgtactgcttcgtcaaattcaactggttctttcttttctttagccataatttcctcagaaatcgttaacgtttttggttaattttgaaagtcctgatttcacgaagtaaggatagattttaccacgtggaggtactttataagagttataataatccagaatttgattagcaatatcttctggaatataatcgaagtcgataagcactcggttttcatagaaacgtttgagctgctcaccttcaagaatagttgtgatatcttcagcgtcacagcattgttcaacaaatgcagttttagttggtggagtgcgttcaccatctacgcgagtgtaccagaaatcagaacgcacagtaattgctgctacgttatctttcttatcacccttcactactttcatcatacaatcaagtgcaggagaacctgtcttcgctttaacaaatttcttctgcattggagaccactgagttacattcggatatttgtgcaactgagtaaagtcaccatccgatgaaacgataagtactttattaccttctaacgaaagctttttagtaaggaccgcaatatggtcatccgcttccattttatcgatattcatcatatgataaggcatgtacttttcaaattcttcaattacagtacgaataccttcgaagtaaccttcccagtcccattcagattcttcgcggccatctgcacggttctttttgtagtaataagctttatcgcgacgccaataaccggacttagcattatcacaacaaataatcaccttgttgtaaccatctttacggaatttgaatgcgttaaatttcagagtgctcaataccagatgacgaagcatcggagtagtgattttctctttatctttgaaggtgtgcatcgccgtcgccaatgcgatttgagacaagtcgactagaatgtaaccatcttttacttggtcttcttcgtcgaacagacagtttaaattagacattagaacctcgttcatttagtaacagagtcattataaataagttctataatagcaaataggagcaccattatggcagattcaatcaaacgcaagtttcgtggcgctgacggcttcgatgctgcgggtgaaaaaatagtcaacgttgctactgctgaccgcacggtgttatccgatggcgtcaacgttgaattccttatccaagaaaacacattacaacagtatgattctactcgtggttacacttccggtttcgcagtaatttacgacaaccgcatttgggtttcaaatcgtgatattgcaaaacctgctggcaattttaatgagctttattggacttcggttcgtaccgacgcaaaatggcgtgtagtttcaagcggaacaacaattttaaaatcaggtgaatttatttctgtcgataccgcaaaaggtaatgacatgattttcactttaccaaataatccgcaagatggtgatacaattatgctgaaggatatcggtaataaaaccggtaccgttggtgtaactatcaacgcatctattcaagacattgtgttgcgtggccctacgaataaagttcgctcagtcaaaatgactcatccactgtctcaatatgtgtttgtgttcagcaatagattgtggaatctttacgtttctgattacgaacgagttgctcgtattgtaacaccaagcgcagttgttcaagctcaatctaacgactttatagttcgcagatatacttctccagacccaatccgtgttactttgcctaaacatgcaaacactggagatatcatcaactttactgaccttgatggaaagaaccctcaattccatatgattgttagtactttcgatgataacaccaatatcggtactgttggtcaaaaatctgtagaagttcgtacttctggtgacggattcatcgtatatgatgaatcagagtcaatctggagaatctgggaaggcgacttacgtccgcgcatgcgtgtgatcaccgacaacgtaactttaattccaaacgaggttgttactgtttttggtgtaaataacagcactcagaaaactattgatataactttacctactgatattgctattggcgatactgtcactattgcaatgaattatatgcgcaaaggacagaaagtaaatatcagagcagctactggagataaaattgcttcaagtcttcaattactgcaattccctaaacgctcagagtatccgcctgataccacttgggtaatgaatgatgttcttacttttgacggtactacttcttatgttccagtattgcaattatcttatattgaacatgctggaagtaaatactggattgttgctgataatgatccgaccgtagagcgtgttgactctaaagataacgaaactcgtaaacgcttaggtgttattgcattagcaagtcaagaccaagcaaatgttgaccacgaaaataatccagaaaaagagttagcaattactcctcaaactctggcaaaccgtgttgctactaaagttcgtcgcggtattgctcgcttagttactttaactgaaatccaagctctaactcctgggccgcatttggatgatgttattgtcactcctgcgatgctgaatgaaaaaacagcaacagaaactcgtcgtggtgttgctgaaactgctactcaagctgaagcaaatggttcaaccgacgatgaacgtatcatcactccgaagaagctgcataaccgtattgcttctgagattttaactggtattcttaaattagtcagaacgactggaactcttgcgggtattggacgtgatactaaaggtactaacgtttatgattatgataacaacattgatgcggtaactccaaaatcgttgttccaattcaagtctactgagcaagctcagggcggtgtttatcttgcaactcaaaatgaagtaattgccggtggtccggcacagcctggtttccctgttgtagttactcctgaaactcttcatggtaaaacaactactgacggaagaattggtcttattcagattgctaaacaaactgaagtagatgctggtacagattacacaaaagcagttactcctaaaactctgaatgaccgtaaggctcgtgaagatttaagtggtattgctgaaattgcaactcaagttgaatttgataccggaacggacgatacacgtatcgtaactccattaaaggttaaaactcgtttcaattcaaccgatagaacatctgttgttgctctgtctggattagttgagcaaggaaccttgtgggaccattatacattagatatcaaagaagcatctgagactcagcgtggtactgctgctctggccactcaggtacaagttgatgctggtactgatgataagacgattgttacgcctaagaaattgcatgctaagaaagctactgaaactaccgaaggtattattcaagttgctaaccaagccgaaacagtagccggtactattgctaataaagcagtttctcctaagaactttaagtatgttgtccaagaagaaaaaacttgggaatctactatagctcagcgtggtttcgttaaattatcagaaaaagcactcacctttaagggtgatactttaaatggttctggtcgtctgcttccaggcgatttaattaacgaacccgctttaacagatttgcctaaagaaggttatgcagtatctccatacgagatgaaccgtgctctgcaatacttcttgccggctaaagcaaaagctgttgattcggatttactggatggaattgattcaactcagtttgttcgccgcgatatcgaccaagtagttaatggtaaaattacattcaaaaaggatgttactctagaagctcctctggtgtcctctagtacggccaaattcactaccgtgaatgctactatatctgttgatattggtgacaccctgggtaattctagaatcaatttgaatactctggcgaatggttggaacattgaaactctggcgaatggttcaactcttgattttactgctacagataaagttctgacgcttaatcgtaatggaaacgtaacggttgctcagactctgacggcaatgaacaaagttgacgctaataagggcttttcagttgaaggtggtacaatggttatcaatccttcctctactgaaattgtcattggtactcaatctaagcaagtaacattgcagaacaaagatgctaagacattctcagttgtagacccttctggcacttacaccattctgaataccaagaatgcttttgaaataacggctcaaggattcgttaagaaagcaggtgattcaatgactggaccacttcaaattcaagctccattaactgttcagattcctgaagggcgagttgctcctgatgttaaaccgtcagacgataacccagcctcatggtctgcatcaattacatcagcagcaatttacaataaattgcctggtttcggtgttccagttatggaaaaagatgctgaaggacaagatactggtttcgtagaccattacgaatatgttaaaggtcctggtgtattaactcaacatggtattggtaagactgcggtctatcaaatttgggcacctcgcccaactgtacaagagttaaaccataatgctcagactttctggattcgtaactttaacatcgtcactggtgagtgggacgaatttggtaagatgtacacttccgttcagagacctactgcaggggaaattggtgctgtatcaacctcaggttcagcgttcaataacttaacgattcgtgattggttgcagattaagaacgttcgtattgttcctaatgaaactactcgtactgttgacttcatatgggttgatgaataatggctaaaatgatggcgagctttggacaaggatttgtccaaactcaagttctctctgagaacaattccgtcaagtataagctagcgtttgcagcgggggtagctcagtctaccccttctgaagcttattatactttccaggatgaacctgctggtgttcaatatgacggtcccggcataaatttaagagagtttaatccaactaacaaccaaatgattaacttcaagacttttaatataaagcctgaagacaccaatgctggaacaaaagcatttgtcaatcatatgaaaacgttagtatcttctgacaatttgcttataattacttcatacgatagattatattcaagtccatctgttgaagcattaatgaaatcaattggctcagttttatggccaagcgtgttcttaacgactaattacagttgtaattattgcgcgttgtattctataaatcgtaaaaagataattgctgaaaatgctacttactctgatttcaaaaaggaggacagagacattaggccagcccttgaattcatttatgataaacctagtgatataggagctactggatattctcaaaaagcaattgatgaccctgaaacttatatcattgataaagataatactagtaaaagatttccacggcaatttgaacaaatatctccaataagcgagtatggaatttctcctggagataaaatgcaatggaactttgaagttaaaggtgatgcttctttaaatgctcctggacaaaatattagagttaacttaagatggttcaaaggaagctcttatttatccggagctgtggtcgaaacaaatcctctagatgcagacaaatgggcttggcatcaaagatatgtcactgtaccagacactgctgatggatttactatcatcgcttctcgttatccagaagttgcaggttctgagggaagcggagctattagagaaatgatgcttactcaagtgtcaagattagtagaacctcttatggaccctgccggattcggtgtcaatggtattcgtatgaataacatgatttctgacggagtagatgaaaatactctattagtccttcctgatactgaagatgataagtctggaaacatttattccgctgatttcagagaatacacagattaaagcccttcggggcttttgttgtttctgaataaatacaacaaacacataaggggaaggccatggctgatttaaaagctaacagtacaattggcggattaccgatttggcaccaggggaatttccctctttttccaataaacgatactctgctttacaagacttataaagtctataccgaatacgacaagcctcaagctgtagataacgactttgtttctaaagctgatggcggaacatatctacaaacagttaactttaaccaaggaatgactttccttgatagtgccggtgctgaagttacaataggaaaagcaactggaacattaggagcaacctatactgcttcaattaaagtacctgctcaatttgcgtttgaaactggtgaaggcaaaccgtttgtaatttttgacccagttactgatatgactaagcctcgtcttattgtgatgggagatgtcttaggtaagtttttatatgatgaagctggacgagtttattcaccaggaaataaacctaccaatgttgatgttggtttaggtaatgtcaccaatgacgctcaggtgaaaataaatacaaccgaattacaaacaatgacaggtccattagctgctccaaatttaatttctttaaacgcagcttctgcgccacaacacgttcctcgttttgatcagattgtcgtaagagattctattcaagattttggaacttattgaggaatttatggcaactatcaaacaaattcaatttaagcgttctaatgttgctggtaaaagaccgcttcctgctgatatcgcagaaggcgaattagcaattaacatcaaagattcaactttattcactaagaacgctgacggacaaattattgacctcggttttgctaaaggtggtaaaatcgacggcgacgttactcaagtaggtaattacacccagactggtaatttcagcactactggcgatattagtgctaaaactgttttagcctcagcaggtgtttcatcaaatggtgatattgttgctgaaagaggtgtaattagaactcgtgctgccgcttcaggcaacgctcatttatggtttgaaggcgaagaaataactggcgaaaaccgtaataaagaacgaggtgttttatatgctacccaacaaacagatacagatgggcgagtaaaccttcgagtttacaatggtaaagcccacgcggctaatacaaacaacgcactgtttgtgtttaacggtgccggggatttcgccgctcctaaagatttgtatggtcaacgctctcgtctgagcatcgaatccgttgctcctacgtttaatggcggacgtctttatactcgtgatcgaacttggaaccaatttggtactaatgagtcatatggctggaatgaccttgtaacttatactgccgggacgaacggtgctctggcactcaactatgtatataaaggacgagcacatctagaaggaacaatttggcatcatttaatcgacgaacgcgatacccctgaatgggcactttatactggcggcactcctgatagaaaaatgttctctatccgttctgtaggaaatttaggccatgctcaagttacaggaagcttattcttaggccctggtggtggcggacttggggtaacatccggaatgggtcaaggctctttagcgttaggtgataacgataccggtttccgttctgatggcgatggcgcgtttagcgtaatggctaactcaagagctcttgtacattataattccgcagccgctaaattccaaattgagcatagaaaagcaacaagaatcacccatactgataatgcaaacacaactattttaccatctaataacacttcaattcttgaggttgatacttcattagatggtaataatgtaggtggtaatggattaactctcttgggttacgtgtctagtggaagatattaccattattttcgtggtactggcggcgctagcttcgatatggatagtggggttaatatcactaaaggcggattgacggtcgttggtggcgcatatataaatggctctgttggttcaaatggacagtttaaaacctctgctccggatggtttaaaattatggaacggcgattatggaatgatactgcgccgttctgaaaataacttctatctcattcctactgcgaaaggccaagcagaaaccggcggcataggtaatttgcgaccgttttttattgattgtgctactggtaatgtttctatgaaccataacgtaacaattggtggtcaatctactttaaatggtaatgttactttaggttcgggtcaaattaacttgcttgggggttcaggtaatattggatttgcaaaagcaggtacaagtccgtattcaatgagaattttctatgccgggaatagtgaacgaggcaacagactagaaatcgctgatgattcgtcttatttgatgtatattgaacgtcatccatctataggtattcaattagttactaatggcggtcatgttaaaaccggagctggaagcgtttatactgaagctatagcgttaaatagtggtgcaagatttgtggctgatggcaacatttatttaccaaatgcaactaatggtttttccacaggttggttattaggccaaattaacagtagaataaatggtgtaaacgacaacgctaataatagagtagccaaatctggtgataccatgactggtaccttgactattaacaacggtgcaaacactggtgtaatggtttctggtattacatctggtagtgataaaggattaatacgaggtaacgttgatggcggcgctcatacagcatgggaaaaccgttcttctggtcttcaattagattgtccgaattccgatggtagcgcatataacgtatggaaagcaactaaatggggagcttaccatattgcagcaatggatgtttatgctcctagcggtaatgcttacgttcgtttagttcttcgtaacggtggtgcccatatatggaacaacagcagttatacatctccagtacagattaatgctcctgaattttatttgacttcagatatttcgttgaagaaagatatccgttcaatagaagattctcgttctaacttgcataaagttgaaattaaacgatatgcaatgaaggacggttctaatgataatgcaattggcgttattgcacaagaagttcaaaaggtttatcctgagcttgtcagtgaaaataaagacgatggcaaattatctgttaactatcgtggactttcttctgttctttggaaaattgttcaagaacaagataaagaattggaagatgttaaatctcgtttggctcgcatcgaagagcttttgtctaaataatttaagggccttcgggccctagaggatttttaaatggctatttcaggtcctaatattggcacttcagcttttaatgaaacaggacaaagagcgatgtcagctgctcgagccagagtaagacttgttgcttctcctgggcgtttatctgaaatgattggacgctctgtagaaataacgataactttaggctctaatcacagttatgaccgaaacgacctgattaataaacttcgcgcattgggttctaccccagcggttgttgtaatttcaggtgatttggttgctcaaaatacaggtgttccttgtttagaatttccatctaacttaccaaatgaatatgttcatttacgagttaatgctaatatctatggccgaggcggtcaaggtggtactgctggagttaacgttggccaaaatggcggcccatgtattttaaacagttttggcactcgtcttcgcatagaaaataatgcagctatttgtggcggcggtggcggcggtggcggagctcgcgttggtaaaaacttggcttctggtggttcaggtggtcgtccatttggcccagccggtcttggtgaaggccgagattctaaaaacggtattgctggtacattagcggctcctggtcctcagccaccaaatactcgttatggctctcatggtggtgcgggcggtgatgttggacgcgccggtgctcccggtaacaaagctggtgaccaagcagaagggtatgtcggtggacaacctggtgcagcagtatatggaaatgccccaacttggattaaagttggtagcgtttatggctcaagagtttaaagcataaatacccttgaaaaggagggtatatgacccagagaacaccactaccaggaatatctgacattttatttggtgttctagacagactcttcaaagataacgcaaccgggagggtacttgcttcccgggtgcgttatctt

SEQ ID NO: 7 - DNA, 41293 bp, Unknown
  bacteriophage genomic DNA
atggcgggtaagacaaagctagaaagggcggaaaagctctatcaggaaattatcggtaaagggtacatgttgttccatagcgggggcgttgttcgcacttccccgcctttgccgcgcgagcttgacgagaaggttttcgaccttaacaggcagctaatcgaagtaatcaaccgagggcttgaataatggctggtcgtactcctattcccgcggccattcacgccttgaagggaaatccctctgaattctccaaagaggaaattaacaaaatgtcgtcggccaattatgagccgttgaccgatttcacgcctccggcatatcttagcgaattccagaaaaagacctggcgtgagctttgtaaaaaattcggcgctgtcaaaatccttactgtgatggatacaatggcgcttgaaatgctgattgatgattatgctgaatggcgtgagcataaggaatatcttgacgctaacggatacaccattattcaaaccaacgtcgctggcggtgaagtagaaaaggccgacccgcgatgcggcctaaaacaagctgcgcaccaacgttgtgttggtctgcttaaagagtttggctggactcctgcaagtcgaaccaaaacgcaagcgctcagcgtggtagaacaagacccattaaaagacggcggaatcggggagaggccgaaaaaatgactgatagcatgattcgcgttcacggactggcgcacaaaaacgtgcaagtagatgacggcattaattacgctattgacgtagttgagggtcgaattcttgtttgccgctatgtgttgctcgcgtgccagcgtttcatgcgggacttagagcgggcggctaatgaaaacgacccgctcttattttcatacccgcgagcgcagcacgttttagattttgctacgcattattgcgttcacgttaagggcaaacgctggcgcggaaagccagtcgatatgatggattttcacgcatttatccttattaatattttcggtttcattcgtccccagattgacgaaattactggcgagcacttcgaagacgaagacggcgacccggtatatgttcgtcgattcactcacgcaatggccttggttgcgcgtaaaaacgcaaaatcatttattgcgtcagtggttggcaactatatgacgttcgcagacggagagggcggtagcgaggtttattctgcggcaacaactcgccagcaggcgaaaatcgtttttgacgatgccaaggaaatgattcgctcatcggaaaggcttcgccagcatttgaagaccacggagaaagctatttttcattctcctagttattcgcgattcatgcctgtttcttcggaagctggaacgcttgacggcctgaatattcattgcgcaattatcgatgaaattcacgcacacaagaagcgcgacctttacgacgttttggaaaccgctaccggtgctcgcgaccagccattgatttttattatttcaaccgctggcgttatccttgatggtatttgtattgagctgaaaaactacggcgtcaagattcttgaaatggaagctgacaacgaagaaaccgacgcatttttctttatctggtatacgatggatgaggaagatatcgaaggtgacaacgccaacacaatttacgataagcctgatttgtggtttaaggcaaatccaggtatgggcgtttgtaaatccatcaaggatatgaaaacgcttgcaggcaaagccaggaacgaggcaacggctcgggcaaacttccagaccaagcaccttaatattttcgttaatggaacattcgcctggtgcgatatggctcgtttccgtgcttgcaagaaatccgataaactcaaatttaccggaaagaaatttatcatcggcgttgaccttgccgagaaaatcgatatttgcgcagcagtaaaagcgtattataccgataacggtcacataggttatttggttaaatactggttgcctgaaggtcgtctattaacctgttccgctgaaatgcgcgaaagatatgaaaactggtacgccaaaggttggctaaaacttaccgaaggtgacgcaattgatatcgcagaaatagaggctgacttaaaagaatgggttgagggtgaggaagattatttcgaagagcttgcatatgacccttggcacgcaacccaattcgccatgaagtgcgcagaaaacaatgggtggaatgttgtcgaagttccccaggtgacgagaaacctcaatgaggcgatgcgtcatactgaggaaacgatgttactcaataaactctaccctccggcagacggagcaacagagtggatgatgagcaacgttcaggccaacagggatagaaacggaaacatcttccctgacaagtcaagcgccgagcaaaaaatagatagcgcttcagctctttttactgcaatatcgagaattatcaggcatactagcggcgtcaatgtgccggatgtgccggatgacatgggaactttataaggggtgatgatgaaaatcattaatttgttcgggcgcaaaagcgagaagcgttccaccactgagccgaagatagggacgatacccgaaggtcttgacgtcttcggcgatgaccctggtgagggtggttggacggttcagcttagcggaggcgatgacggcaattgtcaagagacggtcgttaacaccaacgtaaaaaagcgcaatatcgataaagaggccgcgctgagtttgtcggcggcctattcgtgcattgaccgaatcagcgccatgattgctatggttccttttcggattgtgcgcgaagtggatggtcagattgaagatatcgaagaccatcctgccaggaacgttttgcaagtagcgcccaacgactggatgacgcctttctctatgcgtcgtcagttaatggtcgatgctctgaacggtaacggctatttgtggattcgtcgaaataacgtaaatggtgaaatccatgaaatcgagtattgcgacgaaaagaacaccaagctggaaaacccgtctggaaatcgttggtattataactataccgacgaatacgggaaacagcatcttgtttaccctgaggatatgattcacgtccgtgctttgggtaataaaggacgtatgggtctttcgccaattcagcttcatgcgtcatctatccgaatgggtcttgatatgcaaagctacggcgaaagtttctttaacggcggcgctaaaccttccggcgtaattggcgtgaaaggtacactggatagcaaaggctgggataggctgattaatatctggcgcaaaaacgctaattcggtggctgacgggaatcgtaaaaataacgttttcttcatgccagcagatgttacctataaccctatctcaatctctccgattgacgcggcgttaattcaaagcatgaaactaacgcgctctgaaatcggcggcatctataacgtacctggttatatgattggcgatatggacaaggcctatagcggaaacgttacgactatgatggtcggattcgttaaaaacaccctgcaaccctgggtaactaatattgagcaggaggttacgaaaaaaatcctaacggaagaggatgttttatccggcgtccgtgttatcatggatatgaacgaacttatgcgcggtacgccggaagagattttaaaaatggctaacgacgcagttaagggcggtcttattaccaggaacgagggtcgcgtaaaaattggtgagaagcgaattaccgatgacccgactatggacgtgtgcctggttaacgtgtcacaatccaactttgcagactctaacgcagcaaaaaacgagccagcaaatgataaggttgaagacaaaaccactaacaaagaggtaaatgataatggcgaaaatcaaggctgagtttcttgataaaatcgctgatattcgcaaaaagggcggagtagaactccgctcgattagcgatattggcgttaacgtgcgcagcgaagaaagcaaaaccccgaccattcagggttacgcagcagtggtggaaaccccttcgaccggcttatggtgggaagaggttattctccgtggcgcttttgacggttgcgacttctccttatgtcgcggccttttcaaccataacgaagaggctattttaggctcggtgaaggctggaaccgttcgctgcaatgtggacgataaaggcctgagctacgaaatcgacacgccggataacgacattatccaggcgatgtacgtccagccaattattcgcggcgacgtagataagtcgtctttccgcttctcgatggatttctctaaccctgatgcatggcctgacgaatggatgtacgacgaagagcgcgatattattgtgcgaaaaattaaaaaaatcgctagcgttctcgatgttagccctgtattattcccagcatacgacgcggcggaaagctctgttcgagcggcatcgactttactcgatttgcacaaaaaagccgctagcgaagaaattaccgctgcgtcgttccaggcatcaccaatcttttacatgtaaaaaggaaaggaaatatgaaagtaaatctggcaaaactgcgcaacgaattgcgcgctatgtccaaaacgcagagcgaactgcgctctaagctggcagcgggtcgcggtacgctgacccaggaagaagtaaactctatcgaaaacgagctttacgccagcttcgaaaaggccgaagagtgccgtaacgcaatcttcatggaagaggctcagcgtgaaaatgagcgcattctggcaatgcgtgacgacaacgaaagcgctcacgaaaaccgcgaaggccgcgcgaaccaggaatatcgcaaggctttcggtaactacctgcgcaacggcttcgcttctcacatgttgagcaacgaagacaaaaaaaccctgagcgaattccgcgctcaaaacacgcaagacccttcgctgggcggttatgtggttgacaccgaaaccatccagaccgtgcaagaagaaaagttcacctggggcgctctgtttgccctggctcgcaagcttcgcacccagcgcggcaacgccattcaatggccggtatcgaaagaaggcctgcgccgtggcgtcatcgtcggcgaagctcagaaccacggcaaaaccgaaactcagttcagcacccgcacgatgggcgcgcacaaaatgtcttcgcaaatcatcctggtttccgatgagctgttgcaggacgcctatatcgatatcgcggcatacgttacgcgcatcgctcgccagcgcgtagagctgggcatcgattattacatggttcacggtaaaggcggcgaaaacgagccactcggcctgattgcctcgattccgaaaaaccaaaaagtgaacgtaacactgccgaccgacccggacgcgaaacgcgccgcaatctttgatgcgtttatcaaagttgagcaccgcgtaaactccgcatatcgcaaaatgcctggcttctatcgcgctatcagcgattcgacgctggagcagattcgcatgtggaaagacaaaaacggcaacccgatttacatccgtgaccctaaagctgactggcctgaaactctgttcggcgaccgcctggttatcgataacgaactgccgccgctgggtgaaaacggctgtatcatcgccggtaacttcaacagcctggtggttcgcgaagctggcgatatgattatcaaacgtttcgacgagctgtatggcgaaactggtcaagtcggcttcctggcgtggcagcgcttcggcgtcgtgctggaagatgaaagcgcattcgctatggccgtgttcgacggttccggcgaagactctccagtagacccgttccatcctatgaaaacgtctcaggacggtttcgaggaagaaactgaataagtggttccaccacttgccccgatagtgtaatatgatggagagcgctttgctctccattttttttagggtgaatttatgcaatacgaattcgataaattctttaaaatcgaggaaatcagaaagcagtgtcgcgtatggcacgaccaggacgacactgagctagaggcattcgctcttgccgctcttgaaatggtttctgccgaaattaaccggccaatttatccggccgattccgtcgtaccttgttacgacgaaaaaaatcaaatctggcctgtcggatttaatgcgagaattcgcgccgcttgccttttgattatttccgacctgtacgaaaaccgcgaggcgcaattaagctacagcacgacggagaacagaactctgcaactgctgttaagcccaatgcgctttattaatatccgctgggggtaattatgattagcgaaggtaagttgcgcgatatcgtaaaaatctatgccaggacaacaagacctggcgacgctggggagcaaatacagggctatatcaaattagctgatatgcgagggaactggcgtcaagtaaacggccaggcttacattctttctggaatggagcttagcaccaggaagggaacgcttaaaactcgatattaccccgatgcagatgaaacgatgtatatcgagattttcactaaacctggcgctggggaagtttacgaagtagagactttcaaccacgacgataaagattggtttacgctttggactctccgcaaggcgaatcttaaaattgaaaccgtcttccctgaatgaggtggtggaatggctaacaatcaaaatacgtctcatgttgacgcatcagaagtaattgagctgctaaaagacctgcctttaagtgaaggagaaaagcggcaagcattaagacctgccgctcaatactttcaccaaaaaactgttgacgcagtagggaaggggtggggcgttagaactggcaggatgcaccgcgaaggggttaaattgcagctagccggaaagtctggaaaatatggtgatgtcgcatatagggtttattactcaaaaaaatcaagcagaataaaggggacgcctgattacatggctcctacttttgtcgcaagatttttagagggaggggtaaagcctcactataccgtcaagggtgcgacaattaagaaacaaaacagagggcaattatctcttaacaggtatcaaaggaagttgaagcatccaggattcccggcaagacctataaaccaggagacgcaaaagcgcgaggcggaaaatacttccaacatagcgagaaacaatttaatgaaagttcttaaaaagaaaggggttcaagaatgagaaaaagtcttgtatcgcttttcaaggagaagtttaatattcccatttattgggaaatggttcctgaaagcgaaaaaagcattccggttggatgttatgtcgtcgccaacgactcaaccgtaaaggagctggacggcgtcggcgtcggtctgcgcgtgtgtgatttttcgattgatattttatgcaaagactataaggaggtggacaggattaagttcgaaatgctagtattgtcgggcaaaacaaatcatcgttactgcgacctgttccagatgattcaggtgtcaagcatagaggatgctggagctgtatcagatttaactaccgctgcgggggttgtgccacacatcctttcaatgcgtatttcaatgtatgaatgaaggagctttaaaatatgagctgcaaagacaaaggcagaactggcacccttggcgctgggacaatctttagcgtttcttacgactgcggcgattcgttcgtcgtcgttccaggcatgaccgcaatcggcgcatttggcggccaggctgaaaccgttgaaaccactgctatcgacgacacggcgcgaacctacatcggtgcgcttgagactcctgcgcagaaaaactttaccggcaactatcgcccggaaaacgaagagcaacagcagttttaccaggctggccgctctaaagaccgcgtgcgcattcgcgtaatgttcccgaccaagccgcgaaccgtgtcagagcaggatgtagctttgctcggcttccaggttaacgagcctacggcggaaggcgttttgacgttcacggttaacggccaggctactggaaaagctgactggttcagcgttccatatgtgccggtaatgtcgctcactttcgaccctaaaaccctgaccggcgtcgtcggcggtactgcgcagctcaacccggtaattgagccagcaaacgccaccgataagcgcgtgcgctatatgtccaccaacccggacgttgcaagcgtcgattccactaacggtactgtgaaatacaaatcagtcggcgaaaccgatattatcggcgtatccgaagatggcgatttcagcgaaaccgtcaaggtaacagttaacgcggctcctacgccgtaaaatataatagaggggttcgcccctctttttttcaggagagtaaaaatgattgttggcgatttgatgaatagcgttccaccacttgcaactaagttagttgacgttcctgagtttgggcaggatgcgcagatagcaattcaggaattcgacgcaattaccgcaagtcagtttaacgcggcaattgcaatcaacaaagaaaataccgttgcaggtggcgctattttttatgcctgcctcattgtggcttgtgccattaatgataagggtgaaaaaatcatgccatgtgaacaacaaagcgacttgttaaatcacgcaaaagacctggcggcacgttggcctttcgatttaattctgcgcgtcggcggtgttgcttccgagcttaatggcttcactcgcaaggcggtcgaggaagaaaaaaagccttcaccattgagccaacaaaagcaatcatcaggcgcatcgtcgcggaaacgaaaagaccattctacgaagtagagcgctggccgattagcgaaatagttaaatgggttgctcacttcgaattaacggccgaagagcttgaagagcttcactcagacaagcctaaattcgtcgaaatggttccagaagatgcaacaccagaagacgaagtggcggcatttaaaaacatcctgtgaggtaattaaatggcaattataaatacgctattaacaattactgataaaatgtctcagggtcttgatggcgcaaagaagaaagttaaagacttttcagacaacgcatcaagcaatttaaagaagactgaaaaaacagccgactcactagtcggctcttttgataatatcagaaattttgatgtaagttctttcgatggatttaagaaatcaatcggacaggtaaacacgcagctagttacagctgagggcagcgcggctaaattccttataaggctaggtatgcttggtggcggacttgttcttggtgctggtcttttatataaaatggctagcgcatcggctgattatgtaagggaaatgaggcaggtttctgaatctaccggtgtgtcaatagaaatgctgcaaaagatgaagtcaacgttttcatctaccggattagaaataagcaaattcggagatataaataaagacgttttagaccatctcggggatgcatttagggacggctcaggtcctgctgacgatatgaaggcttacgggttaaacctaaaagacttcaacaaatatttaggccaagctgacggcggtctaaaagctgtaattcattcattttatgaaatgaaaaacgcaggaagaaaccaggccgaaattgttaacatgatggaaaccctggcatctgattcttcgcacttaatcggcacgctaaataagctaggaagcgagcaggctgcgttaaatgcaattacaaatgcaggggctggggtgacttccgagacggccgaagtttataggcagtttgacgagaaagtttctcaattaagcaattcattccaggaatggaaagcaaatgctctggctccaaccgtagaagagcttaacgttctcattgatatattgaatggaaattgggagggcacaaacttcacaaaatggattaaagatttttattacggcggtgacaccgttgtagcaaaaatgcttagggagcttgacggggttaaggatattgatgttcctggagccgcccaagatagacttaataacatggtatcgatggcgcaggataacgcaaaatcattatcaggaacaacatctggaggatggacaaaaccagacaataaaaaaggtaagaaagacaattcagctacgaagcttgaggcggaaaaagagaacgccagaaaatggcttgagcaaatcgatattaataacgcggaagagcagacaaaggctgagcttaattatcgagagcaattgcgaaagcttgataaattccttaaagataaggcagtgacccaggcacaatatgaccacggcgttgcagccttaaatgccgagcttgacgaaaagacccgccagaatacttacaatcgccgacttgctgaacttcaagaccaaaaagggcagatgcttttaactgaaaaccagtacaatgaaaaaatgctggatttggataaagcatttacccagcaaaaaattgacgctcagtattacacggaaatggaaaggattaaattccttcacgatagtaagctgatggcggaagaggaattccagaataagatgctcggccttgagactaagcgcagctatgacctgagaagaatggaagagtctcagactaacaagcggcaaagactcgattacgccaagcaagcggaaagcctaaagctctacaccgacaatatgaacaacggcattaacattgccaaccagttcgcaacagccattcagaatcagcaggagcaaggtacggcggcctggtatgctgcggcaatcgcaacgaaggcaatggcggtagcgcaggctatcatgctggctaacctgactgcggccaacgttgcggcgaccacgccaggcgtgggagcgattgcggcgggtgaagcggccaggagctggggttacgctaacgcggccatgatagcggctacaggcattattgaggttgccggtgctcgcgagtcgggcggccaggttcaggctggcaagagctacctggtcggcgagaaaggacccgaattgttcactcctggcacgtcaagcggcgggcagattacttctaacaagaacctgcgcgaggctatcgacggccaggctggcggggttcaggtgacgtatgcgcccgaggttcatttccacggcaacgactacacgcaggaagatatggacaacattgttaatctgattaacgtgaagttcgacgaaaagattaaccaggccatgcgctacggcggagtgctttacaagggataaccttgctgctatagtgcaaaagattgtttaagttaattaagtaaatcaccaacaaacataggaaatagagattatggcagaagcaaaaaaagacccaatctatcagccgcgcgttgtgaccattgagggttacacgccggaagacctggacgcgaaagtaaccgaagccctagcgggtcgttacaaaaacttcgaaaaagtcggcgctgtaacctacggcggcaaccagaaagttttctatcagggtctgaaagaaaaggctgaaaccactgagccggaaccagacccaggcacaggcggcggcgaataagtcaaaaataatttgacgtaaaacctaaaaagggataatcttagattgtcccttttttattggagagaaaaaaatgaagaagtaccttgcaaaagtaaacggccatttcataactaaacgcggtttcggcatgagccgaaaaaaggcgattcgctttaactcgccagaagctgcgttggcacacatccgagagcatcacccgcacgctatcggcgacggctcggcgcaagtggtggaagcatgaaagtttatctctatgtagtattgggttacgcggcattaatgctaattgctggattctttgtcgggggttcactaaaggcgatgatgtaatgagttataacgtttacatcctaactatgaaaagcggaaagaaggcgaccatgctaaccggtcaatgcgatacaatcgaagaagccgaggaaagcgcaaaagagagattcggtaagcgcctacttaaagttgagaaacgttccaccactcccgccggaatcggccaggagcaagaaaatgaaaaaatatgattcaatcgctaactttgttttggcgcacgccaagatgcaagcgctggctaataagttcgtccaggttcgtgaattcatcgagcgccgcgatgttttcgagccttcggtaattcgcgatgttttccctgaggttgcaaatgcggttcgtgaaacaaaggcagaaaccaataatgtgatttatatggttttaaccaaccttgaattcagcctggctatgatggaagaatttctggatgcccaggaaattatcttcgcaaccaatgcgcgccgcatatgggattgcgagcttccatttactgaagctgacgcaacgcaaattaaaaatttgcaatgaaagtaggtcgcgttgtatgatatagccgctaactctagcggcttttttatatggtgagaaaatgaaaacattcccttggaggcctgttccaaagccaactatcaacagctcgccggaatcggtgattgctaaatttggtaatggctacgagcagacagccccggcaggactgaacagcgacctgaagacctacaatcagcgctacattgtgcaagaggttgataggatgcggtttaacgaattcatgaacgagcatggaacacataaggcttacatggtgttttcttactcgcgcatgaagatggtttcagttagaaataacaactggagcgaaactccacataccggagctgggtattcagagttcacggttaatatgcgggaggtcatcgcatgataaataatgttcctgcgaaaatgcttcttgagtcagagaagctagagcagtcggccaagattcgtctttttgaagttgatttgcgaatgtttggcggagtcattcgaagatttcattctggcttgaatgagaatatggaacctgttgtgtggcagggttatttgtacgagggctttccgaccaagatagacggaattcagcgctcaagcaaaggagcttcaaacaggccgacactggttctggctaacgtgactggcgtagttactggtctatttcattcaagccgcgaactagttggggctaaggttacagttcgcgacgtttacgccaaacacctagaccccgaaaacttcaagggcggagttaaccctgattacgacccgaaccaggaatatgttagtttctatgagatacaaaagcctggaacaataaaccatgagtatggctcatttgagctttcattgcctatggaggcaaacaaagctttaataccggctcacataatcactaccaacacatgccagtggatttacaggggtgagggctgtcggtataacggcagtaagatgtttaacagaaaggatgagcctgtaaccgatatctcggaagatgtttgcggaaaacgcgaatcatcatgcaatgccaggtttggggaaggtgtttcaattcctattcgtttattcccttcttgcgacaaggttggaaaatgattagcgctcacattgaaagagagataaaaaaacatgctaagcgtgttgagccggaagagtgttgcggcgttatcataaatagaatgggtcattatgcatacgttgaatgtaaaaacgtagctgaagacccaaagatgaatttcaagataagttcaaacgaacttattttgtgtgaatcaaagggtgaaatatcagccatagttcattcgcattgtggctctaaatcacttaatcacctatcgtctaacgacaggatatctcaataccacaacccagttccttgggttttattatctcgcggagaattgaagatttacgagcctataagaaaattaaagggtcgtgaattcgttgaggggtattgcgactgctatgattcattcagggatttatacgccattgcgggcaaggaaatgaaaccttatacccctaatgagggttacagaatacctgattggcataaagagcctggagctaagtcgccattccttgaattcatgggtgaagagggatttcatgaaatagaaaggatggaagatatagagcctggagatataatcctttcacttcttggcgctaacataccaaatcacgcaagtgtttatattggagagaacgagattttccaccacttgcccggacgcgctagcgggattgaaactcttcgccgatacttcatagactttaagcattcaatctggagggcttcggacagggaaaatcttaatatcgaagctgcaataaatctactaagaaaggaggtttctgttaatggctaaagtatacctgcatggcaacttgaaaaaatacggtgaatgcttcgaggtgttcgccccaacttttgacaagtgccttaaaataattatgtgtcaagttgacgggcttaagaaagatattgagtctggtcattttgagttctcaaaaaagtctgaggtgctatcaggcaatagcgaagaatctgcaagcctggaggtgtttaattatattcgtggcgcttcagggcataacgacgaattccacataacaccagcagttgcgggcgctggctccaacggcggaatcttcaccatcgttgccggtgttgttgctgtagctgctgcgttttggactggtggcgcgagtattgccgcctggtctgctgctacctgggggcttgcggcaagtggtgcgctaatggtaatatctggcgtggctgctgtatccactaaattgcctggggcaacagcgccaaaagctacggagtcaagcaaaaacaccgctttcagctccatagaaaacgttatgggaaacggccaggtaatcccgctgctttacggggaaaacatgattggctctatggtcgtatctcaacaaattgacacactgccaaaagcagttgattgaggaagatttatgattaagctcaaaggcattttgagggacgcaagcgaaaatcctattcctgatgtaaggattatcctgcgctcagttaaaaatggcgatgttccaactggagttgaaacggtcattatatctggcaaggacggctcttacgaaacagagatttcaactggtagctacatttgctatctgatgattgacgacaaagagaccgccatgcctgggtatgtaaatatttataaatactcgggaaccggcacgcttcaagaatacctgtacgcaccatgcgagattgatgcccgcccgatgtttctgtatatgattgatttagcattgcagcaaatgcgaatcctggttgagtcaaaggaagagattcgcggctattatattcgagctgaagacgctgcatccagggcggaagcggcaattgctgcaagcggaaaaatctacacgtcgatagagcagggcatcgctggaaccagtagcggtgattcttttattgtttcattcagcgaacagaatgatgaatacaaagatatcgcccttggtgtttacaacaacaaagatggaagcgcggagtttgttacgtcaatttactctaaggttgtcattgaccgtattatttcaatgatttccaagagaaacggcaacgagctttcatccggcattagctcggacggcaagccatatttcgtgttcgcaccaaacggcggtcttatgctgcgcggaattaatgggtttattcaggatatagatactgtaaaaaatccagaaaaatataaaaagcttgctggagttgttgacatagttgacgaatcaacactttctgaaaatatagactcagaaggaaaaggctattcactgttcgcaccaaacggcggtcttatgctgcgcggcctggcttcatcggttcaggaatcaatcaaaacaatcgcaaacagggttaacgctattgatggcggggtaacaccaccaaagtcagtcgaaaataaagtaataccgatttacgcgattgacgacaacggcggcatgtactccgctagcgttacgtttagcgcagcagtagacaacgtaacagagcctagtcacatgtcatcatggccgcagggcaaaatgcgaaaaaattcaaaaggtgttatttatcagggttacaacaacaccacttcgcacggcggaagcggcatgattccaagaatcaaatattctgaagacaatggaaaaacatggtctgacggttacactgttgacgtaataccaggaaaggccaggggaactgaccactgggcaattggtgttgatggctctgataatttatactcaattgttagagctaggggcgcaacaaataaactcggggatacagaccataggctatacaaatcaactgacagcgggaaaagctggagttacgtaaaaagcctcaactatgtaacacaaaaaatcggagcagatgatttcgttcctgagctttaccatgatatgctgtattttgatggctatttctatactggatatcattttgcaaattcgtctcgccttggcgttcttaaattcaacccactttcacctgatacggactatcaggagtatgaatttatcgctcatggagaaatgagcaccaccacgctagtagagattaatatcgattatgaccctttcgccagaaagttttacggcgggattggaacgcaaagcgactctgttccagccaggcttttttatgtgaacactgatatgtccagtctgaagatgtttgatgcgccgtattctgttaagtttaacgttatggccgtaaagcgttgcggggactatgtgtattacacaacaatagagcgattcaacactggcgagatgaaggtattcgccacctacaaaaacaactattattctggagataataccaaattcttctcgttcaacatcgggaagattatcagcaaaaaacctagcggagcgtctaacgttggcgttcaatcaatggttgaagttaatggcgacttgctgctatcatttggcacgcaagacaacaatgacaattcattagtttatgttgctaaaatcggcataaacaacaatgaaaatcaaatcacttacagcgatatagaggtgtaaaatgggaagctcaacggtaatactttctggcaacaaaatgacagggaacttgtcgccaattttctttgatggggctatgagcattaacccagataatgccactgaatccccatcgttcaaggttgctgattcatacaacagcctgattgagtacactccttcctcttcggtggaaacaatcaaggctccaaagattgaaacaatttccggcgtgaagtttatttcttgcgaaattggttcggggattggcgtatcaaagtttgactcactgaagggtcagcctgatttttgtttcgttctggttgcagatattaatctatctgaaggccaggcaaatggaattgttgctgaatggaattcaatattcaacacggtttccgacattaacgcaggtttctttgttcgtcgagctgctagtgcaactgactcccttcaattcacggttgacggaggccttgcctcttcagtttcttcggcgtcggttaagtgtccaaagtctggtttaatggttatcgttgcatcgtcttcagcaacaaacaagaaaacctcgattatggttaacggcgttgaatcggaagttaacacgccagcaagctttaccggtattcctggtgatggagccttctctttcggctaccgatacaactacaacggtacgggtcgaatgcctctcaagattgcaaaagctggcatcgccagtggttactttgacgctggcgaacgcctggctctttgcaactcacttatggccgagtacggcgttaagcaagcttgattgcaaatcgcttgtagtgatacactaaagcccctatcctggggctttttttatgagaggattttacaatgggaaaaggtggaggcggtaaagcaagaacgccagtcgaagacaaagacaccatcgagtctagtcagatgatatctgtgattgacctttggtcagaaggtcagatttacggacttgttgacggacttaaaagtgttcgccttgataatactgcggtagttgctgaagacggttcagtaaatatccccggtgttgatatttcatataaccttgggacggaagaccaagattatttagatggctttccgcaaaacgcttcggaaataagcgttggcgttgaggtaaagcagtcggctcctgtaattagaaccattacagaccagcgcatagatatgcttcgcataaatctctatagccgtgctttgttcgtaataaccaatgacggcgacacgaagcgcactgatttaaagatgcgagtagaaacaagaaaaggctctgagccttgggaagttaaagcgcgcattgatttcatagaccagaaatcaagaaacgagttttctttcaaggctgaaatatgggatttaccggcgacgccatttgacgtgcgagtagttcgcgaaacgtcagacgaccagaccggcgatttccagcaaatacaaaactcttctttctggcgctcttactcgcaggtaattaaccagaaatatcgctggcctttaactgcgtacatgggtcttaaattcgattcaaaatcatttgaaggtgcaattccgcgaagaaattatatcgttcgtggaatgattgttaaagttcctacaaactacgacccggaaaccaggaaatataacggattctggaatggtcagtttaaggcggcttacacaaataaccctgcctggattgtttacgatattatcaaaaacccgcgttacggccttggtcgtcgtggaattaacgttgaagaaacagaaatgtacaaggccgcgcaatggtgtgaccagcttgttcctgatggacgtggtggaatggagccaagggttacatgcaattgctatatcactgaacaacgaaatgcctgggatttaataacagacataatgagttgcttccgagctatgccgttatggaacggtcagcaatttgtaccgtctcttgatattgcgaaagacgttgttgctacatataacaattcaaacgtaattaacggcacgtttgaatatagcgcatcatctatggaagaccggcactcagttatagaggttcgatatgcaaataaggccaataactatgaacaggacactgttcaaataactgacgacctgatgatagagcagtacggctggaacgttttaaaggttgaggcattcggtactgatactgaatcacaggcttaccgcttcggctcttatttgcttgaaactgaaagactggaaaggaaaaccgtttcattctcaaccggcgctgagggtttaagaaaccttcctggcgacgtaatagccgttgctgactcgcgccaatacgggcgaattattggcggtaggattctgtctgtatcagaagacagaaaaagcatcgaacttgatgatgaggttgaaattccaaacaactcagaaactctaattatagttatcggcgatgacaggaaaccagttgagcttttatgcactaacaatcctggcaaggcgaaggttttgaatttttccgccacttgccccgaaagtttgggtcgcttgtctccttggtcgttaaaaataaataacagcggtctgaagctttggcgatgcgttagcgttaaggaaaacgacgatgggacttacgccattaactgcgttgagcacgttcctgaaaaaaacgaaattgtagataacggcgtaaaatttaaccctcctgaagaaactttgtatggtaacaacctgccgccagttgagaatatcagcgttgaggctgtagtagaaaaccctaacgcaaacgttcgagtttattgggatgcaccaagaacggcgaggcaaattcgctacaacgttagaatctatcgctctggtaatttggtcacaaaccaaaatatcgataatccatcattttctttcatggcggatacggcgggaacataccgcgcggaaattcgctgcctcggctctgatgggaaactaggtgatagcgttgatgttgtttttgtcattgctgaaccctcaatgccgtcagatgtttcatggcgcgcatcaaacttcacggttacgttaaggccaattcctggaggactggttactataggtgaggtttacgagtggtttataggctcaaccgagcaagaagttttggctatgaataacaatcttggcgaagcgttcgttttaaaccaggttggattaaagccaaatactgaatattggttcggtgttcgagctgtaaacatgattggccgctcggcgataaaaacggtattgacgaaaacggcgttcgaaaccgaatcacttgaaggtcttattgatgttgcgctgcctaagactgactacatcaaggaaatgaacaaagacatagagggtcttggagagcttgcgtctcttagggttgttgacaagaacggcggcaggcctcgcgtaactggtgtttatctaaacgctggtgatgcaggaaacaacatagcttcggtgattgattttgtagctgatgccgtctcaatctcaagtcctgacacgctagagcgctgggtgtactttgattcaaccaacagacgtttggtgcttggtggtgagatacaggcggtttctggtcggctgaaaaacgttgtcatagaagaaaactgcgtcatagaaggaaagttgtcagtggcgaacatcgaaggctatgcgatggaggggcaaagctacgagttcaacataagcaacactggagggagtaagaccataaactacggaggaaacgcaaagatacctgttaggctgttcggccaagtgtgggctagacagcacaaaaaccaaaagactagggtaacggtaaacggaaaaaccataaaccaaatggaggtatcagttatcgttaacaacaacggcacggtgacgaccaggacttacacctggctttatacgtttgttgttgacctgagcataaaccagggggctgaaatcttcgtcagcgccgggtcgctagaccagggtaacagcgaatcctcaacatacaggacgcagttttggattgccccccaatccaatggattcacctctaactaagttttttaagtttttttgaaaaaagtagttgcacaaggatgtgcgttacgatagtatctctcttgtcgaaacgaaacgacaaaacgaaatctaaccttttaatcaggagttaaaattatgtcacgtccattcaaactcattattgctggtgttgcatcttacgttttcgccgatactaaaggcatcgcagaaaagcacgcggccaacctggcgaccgccggtaaaacttccgaagttcgcccgctgaacgacgccgaatatggcgaagttgacttcaaagccgaaaccttcgttcgcgttcctggcggcaaagccgacgccgtagcaactcctttcgccctggtctttgacggcgaagttacttacaagctggccgcttctcaggctgtagctgagcgctacatgagtaccctgattgcagaaaaagccgctttcagcgtcgagccggttccggctgaagaatacccgaccatcgattggtctaccgttgaaactctggaagcgccgaccaaggccgcaggcaaaaccaaagccgaaggcgacgaagaaggcgacgcgaaagaccaggttgaaatggacggcgtcccaggcctgtaaacgatctgccggtaaatcggcgaagcagtaaaaagagttaaaagagaaaagcccattaatttgggcttttttcgtttttgtcgcttgacggtttgctaggttacttgctatagttatttcaacgaaaaggcactaacgccaaaaagacaaaataacaggagcaagaaaatgaaactaattaaagaaaccccataccacaaagtatggatgtcagaagggaataacgtttttggaaataacggaaggcatggaaagtatttagttgttgacgtgtatcacggcggcattccagtgctggtgactaatagcggtattgaggctagattgtttgaggttgtgctaactagtgttgaggttatgaatgattttcttaaagaagcaatagtggaatttagtcacaaaaacactgactttaaccgacaaagagtcattgaaactgagataaaaaactggaacgcttacgcaagaatgtacgaccgtaaagatcttataatcactgatgtatttaacagacgacaagatctatcgagtaaattctcagaaatacaaaaatcgctttaacaaaaaaagggggctaagccccctttgtcatttttgcattttcagcctgtctatcatttcgttcgtttctcctatcaggttttcatacttcacctttccaaccttgccggatatgaacgccattaacagagcgtctacctggtaatcccaggctatgcaggctgtgaacagctttaactgcttctcgctggcaaactgtacgcctggtgggttgtggctcaccacgacccctttcagctcgttacggcgcgacgccagccaggaaaccagaccggcctgtagcgagcttagtttcatagggatagtaatcatctcatcaccctgtgagagtccatgtaagccacctgggcggcgctcagcttggtttcacccatgtattcaaccaggcggctagattcgccctgtaacgacgtgggagccatcagcttgacgcaacaaaaccaggtagtaaccttgcacgcactgaacatagctccaacctcggcatgctccggggatgtataagcgaaccgcttggcaatttcgtaaccggttgcatacacgcggaatgaacgtacaaaggcctcgccatcgcgaagcctgaaaacacgataaaccatgtattcgaaaataggggaaggccggaaaccggcctttgatagttctgtcatttgtttactccaactgagaaacgatattaaagattggctccaaaacaattgcgtcgcgcgcattgtatgccgcgattcttgccgctccctcctggccgtcattgttccagatatcccaaaccatagcgccgcttatatcgccaatagcgtcgttttttggcgtctcaattcccaggattcgacaaagcttatccaggctcgggcgcttggcttgtgtgtcgaacatgttccaggcgtccaacacgtcaaagtaagtatcgcgagaataacggcttgacacaaaccctactttcgggatttcaatgcccataatcattgcccgctgtaggataaagcgaaaatcaaagcctgagatattcgcgccgacaaagcgaattttcttaccctggcctacggcaaaatcgttaacgctagaaatccatcgcaagatgcgagtgataatttcgcgctcgtcgatatcttcctgacccttgaaccggtgaagtgtgaccgggtcttgcataataggcgaaccatctgcgttgttgccgatgattttgaatgacgcggaaataacctctccgccctcttccgcgctgaagctagttttgcggtaaagctcctggaatttgccttcaacgaattcggcgcggaatctgtcaacccacatagcttttaggcctgccgaatccattcccttaaccatgttcgcatcaagctctagaacacggccaaaatcggctttcgtatagctgcttggcggtactgggtctgaaccttcggcgattgtcttgattcgctgaattgccgcttcatcctgggttggaattgtttcgatatcgccagcaatgtttagatagtctttcattttatgctccgttgattttgttgattagcgcctcaattgaggatttggttttttccagcagttccaccacttgcgccttcgttgccttgtgtgggacttctttgattgatttcaggttttcactgaaatcggtttttgagtggaatgcgaaaacgccttcggacatttgaatgtcgtcgatgaatctcaccgcgagcctgatttgtgatgttactgagcctgcggttctgcgcttgtcggtggtattgagccttgacaatgctttgtgcaaaacggtgttttcgtactcttttaggtttcttactggtagtgacatttctttgtctcctgattttggaaatgtcactatatcaccagatggatgcttaggcaatcggtacatcgtcccaaacccaattagggcaaacgtagctatcagccttaaacccattgttgaatagtccattgacagcgcaggagctaccctccaggactacgcctttgtcgtcaagagtccccttgcgatgcatgcatgatgcgcagttatgcatggaaagcgccgtattgataaaatcaagctccttgcttattccgtcattcatgaaaacaacatctgagccatattgctgattcttgacgtaatcgcgaaacccttctatttcctttttcaaagcaaggaagtattcatgggaatgaataatcaccttatcacctctttaagttttggatattttgcgttttgcgttctatccagaattattgaatttatcccaagagacttattaaatattgtctgatttgaaataaagttcatgcatgctgtaacgctgttgtggtgaagcatgttatcaccagtaagcagacgccaccatattgcagattcttgcgtcatgcctattacgccgaaataaatattatggtctgcaactttattcataccgctaaagaattcaatccttatatagtctttgcctatctttgacttcaaaactttcgcagttatctcggaaactggaaactcagggtatgggtttacagtagccatgatttcagcgcttgatgcgtagcgagggtctaacgggtctggaacgcgcattacatgaccgcatccagcaatttgaatccttgccccactttcatcaagaataaaagcacccttttcatttctgtaatattctatgcaaacctctttgctagctggcgtccattgctcaccgcagttttcacaaataatgcacggagcggtagccttttttatattcctgcttgctggccttccctttacctggtctaccgccccaagcctttctgttgtatcagtgaaatcaatccacatgcaattttctttgcctggtgctgtcctggttccgcggccagcgccctgaacgtataaaaccaaagaatgcgttgagcgcatccataaaatgcagtcaatatctggaacatcgaatccggtagttagcgctataaccgttattaggcatctaatataaccgttcttgaattgctcaattagtctttctcgttcagcgctaggggtgtcaccagtcaccactgctgcggtaacttctagctggtttagtattttgcaaaaatcattagcgctagaaacgtcaggaagaaacgccatccatttgtttctttcggcagccaaaaccttggcttccatcgcgcacgaatataaatattccttagtgcgctctgataggtctgcaatgttaaagtcgtcaccgctcattttaatattgctagtatctatgcgcgtacttacgctggattgagggttaaccagcggagacaaataaccagccatcagcaattctgacatttttgtttcgtgggcaatgccgcgatacatcggttttttaccatcggtgataaaaacgccattccctttaaatggggttgcagtaagaccggcatagcaataaggaacgccaatctttttatttacttcgtgcataccgttaaggaattgccaatagctgccagttccattagggctggctaggtggcattcgtcattcagccaataacttctataccccaattcttccgggtacttccttacagagcctattgttgcaacaacaatatccgcgctggcttgcttaactcctacactggctgaatacatgccaacagaaatttccggcggcaatatcttccttaatttatctgcgttctgaatgcaaagctcttttgatggtacggttataatgccgcgtggattatacgcagcatattttgtttgcattaacttgcacaaatcagcaacaactaccgatttccccgaaccggtaggcagcacaattaacggagctttacctggatgtgtaatccagtatttttccgttttgtttactgcgtcatcctggtactttcgattttgaaacacttaatcatcctcgattttagcgtcgaacattttgcggattttatcaatcttcttgctacctatcaagtcctttccgcttgctccgtaaatctcatatgacgtatagctgccgtttgctccagactggctattaacgaatatttcaccagtcaatttgtttgcatactcataaccgccgtcaacttcaatattcaaaaattcagcccatgagcttaaaaaatcactcatgtaaacatgatgggcgcacttatgtaaattaacctgttcgtcaatagaaagttgctttccgttctgaaccttgcaggctgcgtaaccgttataaccgattacgaaattaacgcaatttcggcaagttggtgacggtgagtcaggcagaatgcaatattttgcaaatggacagaaagagcatttatcttcgttattaattctttctggaatggtaactgacgaaactgagttattaactgtttcgtaaattttatgcgctctgaccaggtttagttccaccacttgtgccgatatttcgcctgtctggtcgcaaacgtagataacggatgatttcttgaatcctccgatagccataagtaaatgcgcgtttctgtctaataacccgttatttccagaaactgctgccgagaattggcacttactaagacgacgaacaaatagtaatcctggttcgtttgggaaatccgggtatccctgctttatcgtaccgtcgattctcaatgagatatgaccatgcccgactttttgataaaacggcttatcaacgtcaaatattacgcctatctttttaaggttatatacaacacgcgcaactgctgattggtcaaaatcaattacgtttttaacctctggagtgggtctcattattgaagcccagcgggaggagtagaaattaattctgccgcattcgtcatcaatatattgaggggagtttttttcgcagaaatcggcggttgcctcgttcattgagaacatttttaatagttctgttgtcttgctcaccttatcacctctgataaaaaagggagccgaagccccctttgcattaaagctgaattacatctggttaaagccctggccgaatgggctaccgcttacatttccgggagcgccgtttgctggggcttgcccttgttgtaatggctgattgctttgtccagcattttcttgctggttttgttgctgaacgttctgcccgccgttctgctgcccgttaaatgactgtccaccgttttgctgctggaagccgttttgttgctggccgtcaccagcatttcctgggttttgctgaaactgctgctggccgttaaagccgttttgcggctgttgctgctgaccctggaagccgttttgcggctgctgatactgctgttgttgctgctgttgctgctgaccgtagttcataacgttttgttgctgttgcggctgttgcggctgctgctgaatcgcagtaaccggcagacggtcgagaacttccgggcgaggaatatcgttctcttcgccgccgtattggtcgtttgcgttcgattttttcttgtgcttatagccccaatcgataacgaacgacgcgccgattaacgcctgcgggttggttgggcgttgagcgcctttaccgaaagctgattcacagagttttgcgtattgcgactggccgatgttttgcgcaaccgggttgctatgttgcaggttgtagccgtcgaacagcttgcggttagcgtaaacgccatccataaccgtgcattcaatgcttagtcggctgccgctgccctggttgttggccttgtattcggcattggtgatttgaaccaggtatttacctaccggcaaatcgcctgaacctgaatcagcggttgcattaccatcgacaaacataccgccggaaggttcgccgtaacctggattttgctgctgaaaaccgttttgctgctggaagccgttttgctgttgaccgttaaaaccgttgttgttgaattgaccattcatggttactgctcctaacgttgtatgttgagaattttagaaataacatcttcgatgcaatgctcgtactgattacatcttgaagaccgttcacgcgcaatgtgcattccgtcgtgttttgtctgtaacgcatatttatacattttcgtgtcgttgtcaaggtatctaaacgaacgaattacagtattcattaatccggtaaactggatagaaaacttcgcaccctcgcaaccggcgccgtactgaacagagccatttgcctttatctctgtttcgaacgcattgataaaaacgtgaaccggcaaacggcgaacatcatcaattagacgtctaaagtcaatgttgcccatagcataatctaggcggcggtcttttgagttttcgccggtttcttttaggcacatgtaagagaaattgctagcgccgtcgatgcacaccatatcgtactgtcggatgttgaacgatccgcgatagatatcaccaatcagctcaaaggctgtttttgttttatctatctctacaaaatccacattgtattcctgtagggttgtcatgcctccagggtcgcaagcgattactagcggattgaagcccatgtttttcaggcgtccgatgttaaaggttttgccggtatcgggcaagccatagttaaggatatcaagcttgaatgaatccggccttcccgagttcttgaccattacagccatgttaaagccccttgtttcgtttgctttcggggtgtatgatgcgctcaaggtttcatcgtgtcaaccttttggggataaaatgattcataaaacggtagacgaactaattcacaagtgcggcggtttatctaaatttgtcagcaccttacaaggcatgggtgttgaaatcacccgttcaggcgtggttaagtggtacactagcaaccaggtaaacccatcggaaaaatacagggagagcatcgagaaaatagctaaaaactttgagcatgaaatacaatttgaggcgttaagtgatgacgaataaaaaggaaaaggcgttacagtacgtcagagccggttacaagcttatgcctttatggtggatgcttgaaaacggctcttgcgcgtgcggcgaccctgattgcggaaacaaggctagcgcgaacaacccaggcaagcacccgctacagcacctggttcgcaacggtaggaaaaattcatccaatgacccggcggttatttcagattggtggactaaataccccgaagctaatatcggcctagattgcgcaggctcaggcctgattgttatcgacgttgataagcatggcgacaagtccaacgggttcgagtcgctggatgacctggaaactacttttggggaaaaaatcacctcaaacgtaactgccgaaaccggcggcggtggcattcacatgattttcagagcgccacctgattacacttcatgccctgggggtttcggtaagaatttcccagccattgatttgaagttcaacgggtatattctgctggctccatccaaccacaagagcggactggcttaccagtgggctgatatttccgctgaaaaagattttatcctgggtaaggttccaccactccctgcgaaggttgattcctatataaggaagggttttgatgaaaatcgccattcacctgcgcgttatactgcgccaactcgcccaatcgaccaggacgacgaagaccagattttagaggctctctcatatctggatttcttctcattaagtgatgatgagcgattaaaggtagggatggggcttaaccaggctcttcctggaagtcgcggaaaggcgatttattttgattggctgcaatctgctttaggctctaagttcaattacaagtttagcgaaaggcgttggcgctcttttaagttcaggagcggcggtcgtaccattgccagctttttcgaacttgctcaggaaaagggctttcttaacgagggcaaaaagggtttctatatcgaccctaatgattacgtcttcatggaaccagacctggtgagcgaagagttcaatcagcaaattgaacattctggcgtcatgtatgttaaccacgacataccggttcccatgcatgttgaggaatacgttttacctgaaattatgttcgttgatttctccgctgaacctgaaatagacgaattgcctaaaacagagaaaaagccatttatgtctaatgctaatatctacgggagcaaagacgtgggaacaatgcttgatatgaagcttgagggttacggcgacccgcaggcaggaatgccaacagaggatgagctaaactactggcgcaagaaattatcatttaacccggtaatgtgtgacctgtttatgtggcaggttcaaaactctaacgtattcgtaccggagatagcattaagtttctgcatttcggtaatgggcgcagttaccgctggccgattctctcacggcggattaactactaacacatatttcatggtaatcgcagatacttccgtgggcaaaacgcaaactattaaaatggctaaaaaggtactttcggtcgctggcgatgacaacagaatcggtccggatgatattatttcagataaaggatttattaacgacctggcgaaagacccggcgagatatttccctcttgacgagattggcgagcttttcgcaaatatctttgacgagcgagccaatgcaagccagaaaatgattcgcaaggcgcttcttagtgcttatacatcctatggttcagatttcaaccctacggcctcgcgtgctgattcaaaaaacaatcccactatgaacctgaaaagcatttgcccttcaatttatgggatgactactccggcgaaaatattcgaagctttgaacagtaaggacattgttgacggacttttaaaccgactgatgattatgattaacgaccaaaaaggatatgagggtaaaataccaatgggaacagagttgcctaagtcagttggtcaatggcttcatgctgtaaaaggcggatatcaggcaagttccggcgtgctaatgccagttaatggcgaatcaacccccagcatagaaatgaacgttgacgaggacgcgaaaatcctgaaagccaagattaaggcgtttgagtcgatgagaagaaatgaagaaggtgattttggcggtatttacgggcgtatgcttgagaacgtaattcgagtttcaatcatttttgagcttgcatcaaacccttactcgcgcatgattacagctcagtctatgctttcagcatttgaaattatctcatggtgcctggagaagggtttacacgtcgccaaaaactacattagcgataacaaagaaatgcgcataatgtccgatgtaacgagattccttcgcggcatgccttacggcgctagcctgaaagagctttccacaagaacggctctttctactgacgtgcgccaacgtaacgcgcttcttgggaacctggttcgtgaaggctctattcttgagtttcgtgtcaagaacaagggagccggaaggccttctatccactacatgcacccggaggcatttgcaaaactgcctcctgatgagagagagtgtttcatgcaggttgctaagcaggtgtaacagagaaaacccctttttggggttttttcatttttatgcttgacactgaaagctggttatctataattgagtcaaaagggcatttcgccccaggagattaaaaatgaaagtgtcattccgtggtaaagtttggttcttggctttttgtgttttatgccctgccgtgtgggttggcatcgtatcggccgccggtgttctgtttaacattttctgaggatactatcatgaacaagttcaaggctgttagcgaaatgcttaaactggttgagcgcgttagtgagcttgaatggaaagtcactcaccctgttagcggtaatgttgcaaaaatctacagcagggcggaagaaggtcttatttgttacgcatcatgggaatgcgaaaacccatatgcaacaaatacagaccattgcactttcatgggtgcgattgggttccttaccgactggtttattgaccaattccgcatcgttacgcgcgaaagcctggttggtaaagtctttacagtcggccagaaatcctataaggttgcttcgttcaacgacctggaaacctgcgttatatcggaattttctccgttcggttctggcgttggtaagtcttatcatcaaaacatcgattcactaattaaggcgtttcgccttggaactgcggaaattaaacatgaacattgtggcatttgaagtaactgacaagcgcggccgtaaacgcataatcgaagctggcggcgctaaggaagaaaacgcgcgcatgtggggtgaaacccttgagccgctcgtttatcagtcagaggcaattccatgcgacaactgcatggataccattttgcgtcacggcctggaagaaggcggcgctgtaatctcctgtggggtgaaaaagtgagcaaggtaaaaaccaaagttgagtatatcaaggctcgtgacaaaatccgctttagcgctgacagggcttcttggcgctcagggttcctggttactgcgttcaccgaagataagggcgagccggttcaccttttgagcgcaaagctttttgaccaaaagccaggcaaaaagaaaatcgcccaggtaaggaaagagggcgaagcaatcttgatgaaagaatcgttcgcaggtgaaatggccgaacttctcgatatgatagacgaagagaaaaagcgattccaataaaaccaataagcctactttttaaagtgggcttttttttgaatgttccaccactgcccccgagcttttcccatcaaatcctgtttttcaattctagatttaccccaaaaacaccccttttttagcaaaaagttaagttgttgatacataaggaaaagctgattttatgcctaaaaaggctgttttctgatttccattttcacgaaaaaaggccgttttctctgaaattgcaataaattaaaaaatgctaagtgtatggaatcgttagagtttctctattttagccagttttttatgctacaaacgaattaatattcagggaaaagttttaatgttgaccatatgacaccatataagtcactgttactactactatttttataatttataattaatttaattaatttataactggtaaacactctcttagtgggggggtgtacctataaactataaacttgtatacctaccccatacttttgtgtgtatctattaaaagaaaaaaattaattaattcaccagggggagggggtactaattaattgatttattcttcggcttgtgccatgattgaagggtcaaacaattagctaggaaactataatgacttttcaagaactggtgagcctgtacaacatcaagcccgaacacatcgatgcgttgacaggatatgtgatagaggttgcggcaggttccaggaagaagccaggaagaccaaaggccaaagcagatgaatccgattctgagcataaagcaaagcggataccattcaacgaaatcgggatttgcaatatgacgatttcagagaataaaggattctgcgaaatcctggacggctccgctttgattactttccattgcgatagcttccgacattctgcgagaatgaattacatggatttcgcaagtctcatctttgatgggattgaggttttcaacggacaggtatcaacactaaacgcagttgttaagccagcatctagtttaaggatggatgttttggagcctatgctaagaaacctgttcttgggaactcagttaaaatatgcggtacaggtcaagcgggctatagctgatgagctttgccctacagaaataaaatcgctatcggtagttggttttgccaatccaggccaaaccgaatttatccagggggttcaaaatggaacaactcaaattcacagttacagttaaaccggctcctgaacgtcttcaagagttttgggatttataccaaatctacgatgctcaaactgagtatcaaggcgcaatctataaggcttggggaactgagccggaagaggcaaagaaaaaatgcttagacttaatcgctttagacaaaagaaacgcagtgatacgcaagccgggggacgtggtggaataaaatacacctcaaaccacgacattcagcgaatacaggaattgcagcgattcatcgctatccaggttgaacacgttgagtgtattgtcattgagctggaagcctgcgaacaccgcgaccgcttttatcttgaaagcaagctgagagaagctcgctcaatcctggaaggcgcacgaaatcaaattgaacgaatcagaggaaaatgattatgggtagagttacttatatgggtcaaataccgtttaactctaaagagtacatggcagcatccgagcaacttcaccagtttgcattcctggagtggttgcgaaaaaaccatcccgaccttgcgagaaaaatattcgcagttcctaacggcggcagcagaaacaaaatcgaagccaccaggatgaaactggaaggcgtgaaggctggcgttccagacctcatgcttccacatccgttttacccgtatcacggccttttcattgaaatgaaatccatggcttccggtacagcgccgagcgaaaaacaaattgaagttatcgccagcctgcgccaggacaattacgcggcgttcgtctgtcatggctgggggcaggctgcatggcttgttaccaattacctgaaaggcctaaaccagtacgcagggcgagacgagcaaacaggaatgaatctccttgctcagcttaatggagaatatggcgctgcaagctggcgctaggattttttttaatatactatagccctgcttacatatagggggctttcatggatttacatcaagatgcgattcagtcgcaattccaaagcattaacaagtcgcttgaaagggtagagcgcaacgtagagaaggtttcggaagggatgattcagttggttgagtttcgtaaagaagctgaatatctaaaccagcaaatcgttaacgaccgtaaacgcctggttgcacttgaagagcgacataacttaatggccggtgatgtttctaaccacaaaacccaatggcgtatcggcgtcagtatcttgggattcgtgggtagcgcatcactggccattggtctttttgtggctggagctaattctaagtttagcgacaaaatcaacgaaatggataaaaccatttctatcattcaatcagtggtaactaaggagttaaaacaatgaaacttgagctagtctcatactggcgcaagtggtggaaaatgtggagcgtgtggctgtccattttgggcagctcactttttgcgtttatcactttcgcgcctggcgaagttatggaaatttggaaccagcttccgcctgacatgaaagcgcatattcctgaaaacatcctttcatggattacttatggtatttggattctggctattttgtccaaattcatcaggcaacaaaaacttactcaagaggttcacggcaaatgagtaaaatcgacgaaatgctttacatcgatgaaggctatcgcgagcgtccttacctagaccaccttggcaaccctacggtgggaatcggccagctaatcggtactaagggcgctccgctaagccagtacgtctttaccgtgccgcttgacgtggctaagctttggtgcaagcgcacggtagaggcctacggcgtcaagctggctaagaacgcctacggagccgctgcgctcgctcagtgcaacgacgcgcgtcgcgatgcgctgctgaacatgtgctatcaaatgggcgtcggtcagtacaaggttaaaggcgtgctggggttcgccaacatgttggccgccgtagcctctcaggactggcaaggcgcttataagcacggcaaggatagccgttggtacaggcagacgcctgaacgctgcgagcgggtattacagacgctgctgcgcggtgactattcggcctatggattgtagggggattattccatgtaccaggcaatcgcaggaataattggaataatcgccgccctggtatccgcgtttttctatggaaagtcttcagggacgaagcttgccaaagctgaaaagacggcggagcagcgcaaggaaaaactggaagagcttaaggctcgggagttggagaatgaaagaacagcggaagctgtcagcgatgttcgcgagcatgttaattctggccgcaatggtgatgctcttgacgagctgcgccagtcgttcaaccgtgaccgtaaaaaatgagtgctcttggtctgagctgatttacatcggtgacgatgaccagttaacagaccagacagcgcggcaaatcctctttcataacaagatgtttttaaaaatgtgtagacaggggcaagtggattaggtagtatctaaaacgttcttgctcctgatagttttcgctcgatagatagagtgcctcgcttcatccccctttcaatttttgactgggggattttttttggttccaccacttgccccacggttcggactctgttagtattcatttcacagaagttgccggagcgtgcgcatgaaaatgctatagatatgggtatcttaaacttccggcaacttcaccaaattccttagcccgccttgcgcgggttttttattgcctgtaatatggaggttgaccaagtaacactaattaggaaaatcaccatgaatgaatatgtcaaaaagtacaccccccgccatgacccgttacagggtttcgagcgttaccgcaaactaaagacattcgtccgtctgtataaagttcccctggtcgatatcgcaaaactgctagacgtcaaagaacagacggttcgcgcctggcattgcggaagcgctcgccaccagattacaaccgaaaacctgcgaacggtttttgatcatttcggcggcaagaacgaagacggcgaacctaactttaacccgatgagagatttttaattatggcaaagcttcctggcaagacgtgccgcgtccagggttgtcctggcatagcctctataaagaataagggctattgcgagaaacacaaacacaaagagtgggagaagtatcagcgtaagttcgatggtcaaaaacgcatctatcagaaacccatctggcgcaagattcgcgagcaggtgattaatcgcgctggcggtctttgcgaggaagattacaaaaaaggaatttatgtaatcggcactatcgttgaccatatcatcccgctagcccacggaggccatgaaacagagctttctaaccttcagttgttgtgcgaaaaatgccacaaagccaaatcggccaaggaataatttattcatgggctttggaataatttggaataatttcatcgcccattttccctttgctcgcaaacagctaagcggccgatagcgggcggcctgcctaaatccattttccctatcccccctggcctgtgaaaattctcatcccctcttttttcaaaaaatcaagctttcttcgaaaaatacttttcttgattttcatctaatcatgatttatactttctatgacttctggcgaatcgacctagagcactatcaggagagaaagcaaatgaccacttactacaaaactcttaaaaaggtaactctgattaaaaccgttgagactctttactcaattgttgagaatctcaataatgcagcaatggctaagcaatctggatgcaatgccgtgctagctcatcatttggaagatgcacgccgtaaggctgttgtatatagcgacctgattgggcgtatcaacagtcgcggttataaggccgactatatggaaattatgaagtgtcagggtgatgagttctgcacattcataactgattcttctcgcatgatgcctatcctgggttatggcatcgaagacttcattactaaaacaggtaactatcatgagtaaggttactaagtatgagcgcaacattgtgaatgcgcttatcggcaatatgcgcgtaactgttattgagctgggattgtggttcgactctatgcgcatggacagaccaaaaggcatgattcgcagccactataaaaaggctgttaatgcttgtcgcgttgctgctaatgcatcagaaaagctacataactacagtcgctgggatttgatttcagaagttgagtttacagttatgaataattatcatcggtcaattatcgctgatatcgaatctcgaggttttgacttccaggagtttttaagcgacattgttaatggagaaattaactatgagtatgattgatatcgaaccaaccaaggcaatgattgaggctggagttaatgaacttcttgaactttcgccggaaatcgccgacgcttacaattgcggcgacctttctcgcgagtctttgcttgattacgtcgttttcacttatcaggctatggtaagtaaagcggctgaaggttaacagggttccaccacgcttgccgaacgtttgggcgcagtggtggaacaatttatagttaatgattaacggctcaacgccaaagttgcacgttatcactttagagggttttattatgattaatatcactaagggcgaagggtatgatactaatcgcgctcttcctgtaaaaacgacattagtggagaaaaagagcgaaccaataatttaccttggcgtgtcttcctctgttgtaagtatctccatgagcgggtgttacggctgcacggagctaagcattgacgaggctatcaagcttttcgctggcctgctggaagacattaaggcggcatctgctgaaaagtaaaatttgattattatcaaagccttgctaacgcagggctttttattttgaagtttttacagaaaagacttgatatcctttattgcgtttcctacaatctccatatcgaaaaaaaacgactaactggagataccccaaatgaacaaattcgaagctaacaacctcatcaagaaatccgatttttgcatcaagcgccacaacctggacggcactaccgaccgcgaaatttcagttaacggcaaaaccattgctgttatcaaccaggttggtcgcacttccggcaaggtgttctatgtgcacattcagggtcgcaatcatcaaatcgctgacaacctgaaccaggctttcgctatgtgcctggaagtgtttatcgaagctatggcggttaacgaaaaagcgccggtagatgacgccttagtttctgacgaacacattcgcgcggtagttgaatcttctattccggttggagaaaaagtagtgaccgaagaaattcaccgcttcggtaatgctgatgacggccgcacgcataaaatctttatcagcattgtttgtcctggtagtgaaatcgagcgcttcaaatacgccgctcagctttacgttgccatgcataaaaattcgcatgtagtcgtaaaggctggtaatcctgtattcagcaccattgacgctaagatgcctggtgcgacatatctaggacatcagtctgatttgcgcgatgctaaatggagcattagcgcgattgcagcagaccatgataaaggagctgtaattctcaagcctggtgactttattgtgaatgttgacggtgatatctctattgttgaatctgttcgcgaagaggattactcttacaagctcgataacggtaattacgtttattgggtttactcaaacggtaaggtaatcgggaataacggcaatgatattgactggaaggaaacgaaaaagaacttatgaaataacatgccggtgcggggcttataatttcccgcatcggctaggcggcggaaaatgcaacctgttaagtatcgttatagagcggttccccggcaattactgtaaaacttgtaatttgcttaacaatggttgcgaagttattaatggcattgagagtcctaaagaatgccattatgtccaggagctgtttttatttaatgaggttaaattgtgaaagatgtagttgttaaatgtacgcagtctgacgcgaaccattttttcgaggctggcaatttatataaagcaaagttttttaaaaatggttgccttagcgtaacagataaatacggcgtccctcatcgaaccgatagcaagaaaaatattacttgctgggttcacattagcgggcgtgaaatccttggctttgttacttttgaggttcaagaagatgaagcttccacgttttaatgtaaaccgcaataccggcgatgtgttcgccgaccctgaaggcgagttcgtgttatttcgcgatgcgcaagataatgccgctcaggtaattaaccaggcgattcacctggcgcagcaaatcaacgctatggcaattaatgccggtctgattactgaaccaacgatggatgttgttcaactagggatgctctgcgaagatattaccgagcatttcattaatccgggtaaggagaaataaaatggaaaataaaacgctaaacgaaaacccaaaaaagcacattatcagcaaagccaacaaaatgaccggcgtcaagtttattgacgatatcgcgagagaagtattaaccttgcgcgacacggtggaaagcgagtttttgtctgaagaaacatataaggcgatttcggcgattatcgatatcaatgaaattaagtattctaacgctctggaaaattggctggtggagtctgccaagcgagaagactattcatgcgtttgctctgaaatagcctcatcaattcgcatgattggcctgaaggatgctcacttagatgctttgcggttgctggctggtggctccccacggctcgctaaggacaagttagaggcaatgcgtggtgattcattgcttgatgagaaaggaatcgactatggcctttgagagcgtatttcctagcaacaagcagcaaaagcggcgcggcgtcatcggtatgacggtatggtctaacggtcagtgccgcattgacaaggtgattaccggcgacctgccaggcgtatacatcgaaattgacgctcaggcgcgccgtgtgcgcgtacgggcggataagcaaggcgaccgcaagctcagtagcattaaccgcgtacacctgccaaaggtgccttgcctggagctttgcggtgatgagcgcaaggtagttatcgagctagagcttgataagtttgctgacaaggaaggaaagttggtttcctggtattggggcaaatactaaaacgaggccggattaagttctggcctttttctttacttggcgtcataatgccggaacattccaccacttgccgcaaagggggttcac

SEQ ID NO: 8 - DNA, 42794 bp, Unknown
  bacteriophage genomic DNA
  misc_feature (42793)..(42794): n is a, c, g, or t
ggctgccggtcctgcgattctggctaacgcagaggagaaagaagccgtggccttctcggcagcactaccggaggttttcacaccatccagttgcttcttaaccttgtcagtcccggatgaactagcaacaactactagacgagccgtttcagtggtcattcataactctccagtagattcggtccaatcttcgaatccattcaatgtcactacctgaaagctcatacccagtaaggtcgatgaaagcctttatctcctgatatgagagccaaccgtcgttaatcaacttaaggaagcactcccacaggtagaagagcgattcgggtagtggaggcacatccagtgccttgggcttcttccctgtttgtttccacacccgagtatagtgctccttataagttacttccgaccctttcggccttttgcagagtttgaactccgcttcggcgtactcggcgagccgctcgtactcgctgtcgcaaagaactttcggttgcctgccagcgtatcgactatgctagcgatgtgtggagcttccttgaagaagttagccacgttctccacagtgcactcggtttcgaatgaccagcccgttactaagtgagcctgaagctcacgtaaaagctcctcccccttctccaccttctgctcgggggtttccatatcctggagctcccgcagacgtttggagtagttgaagttggctcggcggaaccggtcagagtccaagccgatgatgtgcagccagtgctcagtaggagttccgtctggtagacccaggggaacccgtctaccctcgttggcttgggaacgggtgaagaagtcctcaatcttagccatagtctaacgcctctttttattatggacctactaccactgggatgcgagtaatcgccaattgagaacccagggtctcgtcgtattgagcggagaagggcatcgtcaggacgatgtcatcttcgccggtgatgtccggttggccgccagtgaatttaatctttggcatgttaaattcgtaggcgtttccttccgggtcttttacggtaaacttgaaagctacgtcctgctcgttaatgaacatgttaaccagggccgcagattcgaagtaagccgtcacctggccggtcaacgtcgaacgtttaatgccaggacggattgtcatatcagaaccgataacaaatcgcgtggcgagcccgttatcaagattcagtgtaacctccgttgccagagctacgtccgtaccgttcacagacagagtgccggtgaaggtgtccatgacctggttatcgtttggctcagtagtggaagagcccgccggagcccccgcagtcatgtttggctggtcttggccgatagtcccgaaggtaccagtaacgatggagtttgcaccaaccgtcagggccagggtgttcatctccacaccgaggtaggtccagtatggcaaatcactcaggtcggtgaagtggcggagggcagtgaaggaacgacgaataacgccagccttaagtacgtctccttgccaagtaccacacatgacggcttccagcatagtgtcttgggagccgtaggacaattcgaagttgacgtcaccgcctacctggcgagtaccatgacgaatggaacggatttgacggtcagcagtaagttctgcggaggtcagggtatccttcgacaggcccagggttgtcccggtctggcggaaggtggtgaagactgcggcggcgttcatcacaccgtaggcagtttccggagcgaagtacagggtatgcattgcaccgctagacatagttatctcccaaatctagtaaaccaactgatggtcaccggcaccacccagtagcttccatctggaagacccgctgagggggaacaggacctgatactgagccaggtaccaccagactctagacgtgtgccagccttaaaggcctggcggagtaaatcaacgtcccttacctgcttaaccgtcccagagttctgggggtagtacagcagcagggtaacgaaaccgttgtctgaaccatcttgaccacccaggcccatggtcttcacgtttacatccccatagtcgatggtgaagtagacatgaaactggttatcgggtggaacgaagtttttgttgggccagcccgtaagagcatcggacgtaagccccgtggcctggtaagctcggataagagccttttggatgttctctatagcagccattatcttcccctattgacctgagactgcacctgcttaaggatttcttgaacccggagaacgtttctacgaaccataccctgaggagctttaacggaggaccacccaagaaactctatccgataggcgtatggctggttgttcgttaggtagatatccacaccaaacgttgaggctccaaccgttacctccatttgagatatggtcaaggccccactcgggtcagctgaacccttctcggaggatggattttgtttggtagtcttccaggaacctcggagagtaccatccaagacgggggtgtcgaagacgatgtctcggaagagcttttggatgagtagtatcctcgttctctccaaggtctccatcgtcccgttgatggctcgggtcatctcggattcgaagcccatgattaaaccctcttggtagtggccttaatcagcagcagagtctttcggtcaggactgatggtgtccacaccgttaagagtggtccattgtccgtccagctctacctggtctcctgacctaagtccccattgcatccccacgggagacgctaggaccttctggtcatcgaactcggtcttggactggccgatagccgacaggatggactggagaaaggttccagtctgtgcgcttaatggaacggcgtacagggattgggttaggtactgagcttcccccggctctgctagggggtcatcgtttggaacttctcttcggaagttgagcttcaacccgttggaggcattcttgatgagaaccagtacccggccttgcagtcggatatagttcatgctcgtaccacccttgcctgctgaagcaggccaaccgaagttgactgagtgaatggagacatcatgttgtcaatcatgtctgattggaatgggccagtatctccaccgtcagagtactgaacctcgatgacgtccaccttctcacgaaccacacctgaagaggttactggtgacaggtcatgttcgtaggccagtgcagtgagttgcatctgggcgtttttgattcgagacgggatttggtcgggggcgtatcccttgatgccagtccgaggaaactccagctctgcatctgggtaggtcttctcccccctgtactggtagttgtactggaggtagtcaaccgcctgatgcatgagagattcaatatccgggtcggcgtcgggaagagtcagtcctcgagacagagcgtattgcttggtctgctcgagactgacgtaagagtttgcattcgccacaccagagccatcttcaacgataatcatttttctctccgttggaaggtggtgtaatcgttccagtggcggagtggggatataatacccctaaagggtatttatatccacatcctctctcggcgtaccgctgacgctatcgccgaagcgctggagaaacgatgaaaccagttatttctttgccttcttgcggcgtttggtgttggccgggactacttcatcttcttcatctgaagtttcgtcctcaggcagctcatcagtaccgccgttgacatccccgccagaacctgcggcattatcgtcatcaggattatttccatcggtattctccccgccgttatccgattcaccgccgttttggtcctcagcggtaccatcaggcgctttattaccctgaccctgggggttatccccggtttgggttgaatcggccttaatgcccaggatttcaagaatggccgtttggtgtttagtcaccgtgtagccctgatactcggttgggataagtccgcctacctcatcacacttctcaaccgagccgtcatggaattgaacgttgcgaaaatacagaccagccacttcaccagcgagagccttcagtttttccgggtagtgattacccattacgaagaccaggatgcgcttcttcattctacttctcctacaaaaagaaaaatgagtatgggccgaagcccatacccgtgtgagcaaggttgctcaatagccccgctggcgttagagggttttcaccaggacgcctggaccatccttgtagtaggtcgcagttttgtcccagttagcagctgtagccagtgctgcgttggtgggagacttgccgcctgcagtggtatcccaggtgaagccccggatgcccaggttgtaagtccattcggcctggtaggtggcctggatgttttcgttgccattacgagtatcgacgttatcggtgaactcgtcgttgttctgctccactgtggctgcggcagagttcaggccaatctggtagtagttggctgggttttcacctgcagccggtaccatcagcgccggggagtcagtgtagaccaacgggcgaccaaagccatcggtcacaacgttcacagtgccgaaggagaacagacgttcctggttgaccagcgcgttgccgtagatgtcgaagatggacttcgaatgcatcagccaggaacggatgtcctggttacggtcgccgaacttggcagagccattgttcaggttaatcagggacgcggtgccacccgccggattggcggtgccatcgtagttcacttccgggatagtggtcaggccagcaaccagggcagcgatagcggtgttcagcatgtcggccaggttatcctctgccatctgcttaccgattaccgcgccggcttcagcttgggattttttaatccacttcatcatacctgggtcaatagcgattgggaagataccacccgctaccttcacagagtagttgaccaactgagacagctgcttggttgcgatagcgccatcggcgtatgcgttacgacgacgaaccaggccctgaatcttggcccacatgacttcgccatcgaagtcgccttggttcagcgtggagctggtcagaatcaggccgccccgtactgcttcgttgaacttctgaaccgcttggtcttggacctcggtcatggtggtgtacagcgttttatggaataccttcaaatctgcgcgcatggcgttactcctcggttggattttgttcgacccaagccgcaatctcttttgcagatgcggtcaagaagtccggtttctgacccttagtgccttgtgcaccaggacctttcttggatgggtcagcaccgccgcccgaagcaccactaccacgcagggcgggtgcataatcaacgttgtcgttgatggatttcttaaaggcgtccatagacatatcggacacctcgccgtcgtctcccttcacacggagagtaggttcatccccatcaaagtccataacgagacgagaacgaatgtgcgggagaatgagtccaggtgtatcagacaggtcccgagccaagtccatagctgctgagtcaacgaacttcttctcgaagcgagtcttccactgggactcggtttcacccagctgcttagtggtatcggccagcttgcgattggcagtgtccagctgacgttgcagacgggcagtctctgccgacttatcgccggaatcgatttgctcttgcagttcgtcaatctgggtctgcagttcacgggccttttgttcggcagcctgacgctgagtcttttcatgctgcttcgcacgtttgagagcaccggtgtcttcttcaccttccacaccctccagaacccactcaccgtcaacctcctggtagtacgattcgaggccagcaggaatgtcttctttcttagtgaacttcttttgaacctttgccatgagcactgctcctagacgtttgcagttttaaacatatccgggtacttcgtgcgaagctctcccaggttgagtggacgcaggttttgaacaacccgctttgaaaattcttcaggcttcacaccgccgtttctgaagagctgacccatggtcttgcccatcgtctcgtcttggtaggaagccggttgttttgatagccactggtagaaggactcatcctgcgggacgtaaccagtagcagagctccgtgtggctgtggagtcatcgtctttaccccaataaggaaccatccgagttcggcagttggggtgaaggggtggcacggggcctttgcccacagggtagtgagtcaggtcgagtgaccggcagagctgggacgttctgctgtccagcgtggctaccagttgatattcttccaggcctgccgataggtcagactccaggaaggccacactcgagacgtgttggtaggaggtcctgataacggacttcgcatcggagagcgtaccgttccatgaaccgtccttgtagccgttcgccttcgtaccccgaatagctcggagtgtctcgggcatggttctccccattccccaagatatcataacctgcctttcgatgcgttgtatctgggcagaagagagattcttgacgaatggttcgagtaaatcacccgttcccgtaatcggacgggttaacgtcttaccccagaccccacgaggccgagcgaggcccactgtagcgcccacgatttccgcttggctggtgattataccggattcaacgtttgtctcgtgtacggacaggttttcaagattttcccataacgtatcaagatattcatcccaaatcttgacctgggcgttacggagctttttcttgagagccgtgaggtcacctggccaatcggtatagccagcccacacctgcttgactgcacggtcgagctgagccagtaccttttggaagtcctttatctcaccgttcttcatccgctccagtaagacagcagccttcatgacctcatcggtaatcatgcagccccctactcgaaacgagactgaatctgggcagccatgaactcatgctgaagactaaccagaccgccgaggatggcgtaggggttctgaccagagtgccaagcgtccatgagattctggtccttatccagcaggatgatggccacactgtgagccccatgctctttgacgtgagctagggccatctccagcagactgactacatggtcagtgtccgtctgggccttctccttcgtgaaacggagaacgttacttggtgtcggggtcggttgggtcatcagggttatcctcgtcatccaggtctgggccttcttcggcatccttcaacgccttccacttctcccattctttatcaggctcgtacccgatacccgagcggcgaatgttccagcgatactctgcatccgtgataccgcctgcttgccactcagcaatgagaatctgccgttcctgggcagtcatcttgttgaagtcgtagtcggtgctgatttccagctccaccttacccgagtcaccgataaactgttgacaccagcgtaaggcctggttgtaagcagctgagacgttcttcgcacacttggacagtatggagtcttcagtcattgccgcccggttagtgaaagtggctgttgtagctgccgtgctgacctcaatcaacttggcccctaaggaagcagctcgtttctccttggcctccatcgccgtagcgagaggagaggcatccggcatctgcagtagacccgcctgaccaccgtcaggaagcatcagcatggcccgtgacccgaagtagacaggcttatcccccatcacagtcttcttgtggtcctcggtgatgccgctaatccagggagtcggttgcccggtcatgtggagggcttcctcatagtccgcagagttacgcaggtggccgatgttcagttctgccagcggatacagcggagggttgtcaatctccgggtcattgttggtcacaccgccaatgatgaacgggatttccttccagggcttcccagtggagtcgagcaccaggctttcctcggtctgggatagctccttcttccgctcagccacttcgtcggcatagcgatagatttccatggtgtaacccttcggcgtcagacgcagtacacggtactggaccttacacacctcttggaaaccgtcgtcggcatccaggtaatcctctttcaggactacgagggtcagacgcaggaatcggcctacccgtgaagtacgccagttgatgatttgctctggcttgtacatcaggatatttggtcttactgccccggaggccagttcggctttggtggcagcctgttcccgtttggggtagtcgaccagcagaccatatcgacctttggagatggccaggccggatgactcagtagcctggtcaaccagactcacacctgagccatcggcatcatcagcaacgtgctgaagcgctggtgtcactgtgagctgagggtctcggaagaacatctggcctacaagaccagcctgagttcttccggtgaagttgtaatagatggcacgagcacgataggccttgttcctttcggcatcgtattcgtcatctccggttggaaccatcgggaagatgtacttctcgttcttgacgtctgcgtcaatacaatcctggatgagacaccagattttcttgtactggacgtagtcctccctttcaaaggcaacattctgcgacattatctagtctccaggctagtagctaaacgcttggtcttcagagcacgataacgaacttcgtcatataagtggtcttcagcctttgtgtcaacgtcctcggtgttcttggggtcacgagggagaatcggcagagtggagatggctgctcggcagtgactcatgaagtacataccgggtttctcccctcgaacggagttcttcaggaactggcgcacgagctccaagccgattatcctcgaaccagccgatttgtcggacttactccaacgaacatcgtacttggccatggaatcagctatggttggaacccctttctgcaccacgttcctaatctggttatcggctggacctgggctgacgcgggtagacactaccagtccgtctttgctcagtttcgtccaaccccacttagcctctcgttctataatcccctgggcgatttcttccgaggacagtttaagtccctcgttgagtcctatctcctttgccccataccattcgttgacccggataatggacccaggagcgaatgaacgagtaacctcgtactcagaccattccccattgtcttccaagacgtcttcaatatacgagacctcttctccgttcgactctgcccaccaccccacactgaagggatgcgttgagccccagtcaaaggagcggtccatataccagttcttcggaatcgtgaaacgaggcacgatgatatgctccggtttccaaacgtcgtccagggcaccgcctgcaacgatattccagtcaccgtctttcatcgccttgaccaatgctgggtctccgaggccgtcgagacggtctaagtatccagggtcgtgtttcaacagggtcgggttgtcctgcatgcgagcaggtacgtaggttctcagcatacccccgtccacagaacgggtacgcagcacttgcataggttgacagtaatcaacgaaggttcgtttgacccaagcgtggcctatagaaccagggttagagccacagaagatgagtggcagcttcgagcgtaagttgaggccgggtatcaggtcttggtctgggatgtcgatagtgcaccgcacacggtttctcaggaaccgatactctttctcctcgaagtgggtcagctcatccattagcaatacgtggatttctgaaccctggtactttatcaggtccttcgcgtattgcaaatggcagaggtggatggtcgcaccattccagaagacgattttgtttctgctgggaatgattcgaaccagacctaactttgtccattcgtgcaacatgacgtagaatgaggatggaccttccatatggttcttgtagaggtcgccatagtttcgacggaagaggtatatctgcaggccaggaacagcagtagccaaaagaatggcgagaaaccgcatcatatgtgatttcccgccaccagctgccccaccatacagaatctctgtagccgtgttcaccaaagcggagtactgcttagggtgaaggttcacgtccattctttgagtcctgtttaatggtcttacccatcagaccggcgatagcaaccacagcagtgagtatcgccatccagtcagcgggtaagttgtcttttaacttatcgtacatggccaggtagaccgttggaatcgaacctgccagggtgagcgcccacgtcgaagcgtgacgccatacctggttaacgtccgataccgcgcccttgcgcttcagcagaagcacgtatagcgtcaacatcaccagggccaatgttaatactgttagtaacattcattgactcccttgcccgagtcccgaagaaccgttggatggttcgaccggagtcgttcatcacgaaggcctcttcagaagtgtacagttcaacccgttccatcttcccgtctgcccgagtaacgtccaaatcgccattgtccagttggcgtacctcttggatttcgtgaatccgggtgccggtttggtaaaggtacttgatagtcagcatagttcttctcctacttctcgttctcgtacttgatagcagcatcagtctggtcagcacaccagtagaatgacccgagggcctcacggagtgccatacgcagttcatcaatgcttgccggttttcccttctttggatacgggcatgccctcagttcgtaagcctgtcggtctgtcatcacggtagtacgattcgagcaggctaccaaggttgtcaggaatgcgagtatcaagaagagctttaatgtgtgcatcattcgccctcatcgaagaaagctgttggtccacaccagcaaactgtttattctgagcatccgtgagttggtccaggaccatcagaatagttcgttggcgtttctggtcttcggccatctggccaatcgcagcatccttgttcttcacctcggtctgcagcgagcctatcagcgtggtggcctcgttgtacttggcgtttaacacgaataggcctgctccaagcaggatgatgagagccacacagccagagataacgtatttggtcattgtccgagcctcgccttaactaccttcgtgtaaatagacatggcgtattcagcacccatccaggcgagtacgccggagatgaaagcaccaagacgcatatcccatcccagtaaagaagtaagaagaagggttaggacgcagacataccctgctgacagtccagcaacgatacatcgcccggtcgttatcctttcccccgcgtatatgctgcgggatatgtagcctaatacgcccccgaaggagcaaaagagtgccagggctgcccctaaccccaaatctttatccatcatgccctccagttttatgcgagggctttggcgtactccagcgccatctttttatcgtaattgaacttggagtagttaggcccgttgtaaatccgggcgaatgtactccactccttgttcctcagcgccctcagaagtctcgagtcggccttaatgaacttcacgaaggcgttaagttgtccctggtcagtgtacatctcattaataaactcctggagagacgcataccccaaagtcttccagtgataccccataacctggaacgccccccagctggccgctgagagcgcacagtcacggtcaatcgatgtcgcccgtgccagacgtccatgctcgtcattggtatagccgcccggagacgtgtttaccaggtcgggatattgacgagccaagtaatcagccgtggtactaccaagcttattggccaactggcgatacatgacatgacgctcgaagagaaccttaggaaccttcatacctgcatccactgtgaacccgttgccgttggattccacagcagccacagctttgattgcggcttcctctgcgtcgagttcaagtgctacagctttaaagtccacgattcacctctcaaaaaagaaggcccgaccaaatcgcctgtgttatgccagggtcatcagtcgagcctaatggggggatgtcttcttttcttcttagtcctcaggtagcgctgagttctattcggttttacctaccgtgatgttaatcacaggagctactgcagcgttggtgccttcaccgcgtttgtaacgcttggcatcaagcaggtatttgagtagttggggttctccgacccgagcgaatgttgttgctgcttcttcgatgcggtctgttgcatcatccactgcatcgtagtaccgctgttgaaagtccgggtcctgcatcttctcccggtactgagctcgagttaccgatgcgacagtgcaagcctttcgaatggagccatgtcgtgatacctcaccgaggaagacctcccagacgtcacggtttataaatcctctccgtttcgccatcagatagttgctccaggaagcatggggaatcttacatatactctaccctcaaatcaaccctctgtaaacagaaacttcataactcattgatttacatacaaaaatgggaatgagctaaacttaacccattcccgtaagtcattgatttacttaactaaaacaataccagcggtaagcatcgttcgaccaacgttaatcaatttattggcttcagacagaggaatacccatgtgcttacgcacagcagaccgagagaagccacgagaagcaaaaacccgtacagccaccatttcatcctgataccccgcctcgtagaagtgagtccacagcttctggatgatttcgcttttggactggtcgttgaaactccgtgcttcctgaaccggagccaccccattgttaagcataatccgatactcaatgccagaagacttaaaccccagtctaccagcatcagccaaatcacgatgaccagaccatctaacccagagaagtaaccatgcatcaacgttcaccattagaaagtctccgataaacccaacgaatgccaaaccacactgggatgagtaatccagtaggccatgcaacgatttcaaccagaggcatccaccaaggccattccttcagtccagccagtctttgaaccagtagctcaatatagcccaaagcgcaccagataacaccaatagtcaaataccccaaaacaaacacagtcattctcttctctccaagacaacttgataaagtaactcaacagcctgttgacgagtgagtccaccaaatttcattaagtccttaatcgcctgctcaacaacagctctgctcctattcttagttcttcgcatcttctttcccctaacgtgagtgcggttagcgttagcgttccgcacgaacgtgtatcaaccgtattattgtcataatacggtattgacaatatagagtgttgtcgtgcgtgtaagactctatactctcacgcgcattatgcgcacgtgtggcctctatacttccccgcgtgtgagactctatacccacacgtgtgagaattatgagccaacgtcatatccacggttccagtcagtgtagtcttcagttccgtgggggaaggggttagcagaaagagaaccgtctgttaccccactatcagactgagcagcagacatacccagttgataagcattctttggcttctttactcctgctttgccggggtcaaccaggttaacaggaccagcccaggtaattaccagcccgtcattctcgaagctgatttgaatatcactgcccaccacagcttcaccagcgtgaatggagttaaggaacatgtcacgtatctcttgctcgttgagagtaatgcgaccagcctgccagacttcagttttcatttgcgtttccttagttctttagtgagttcatcccgcagaccctcgagatgattctttcggtcttccacatatcccagctctcggttgcagtagtcgattctgctttgaatatactcgttagaccaggttgagtattgaccagccttataagtaggcttggggttttggtatggccggttatcctggaacccagcactaattcttctcgccatcgggtttcattcctgcatagtggagaatggtatcaatagccggagccattggcttaagcaccttaaccgtttcaatgcaggtgaccatgcccagcatcgcggccttataagcaatctccttagagtgtgggtcagtggcgatgtcagccgtttgcatacagttgagcacgtgaagctgctgtgccatcaggttttctaccagcgttgaaaagttgtttttcatcttgtaactcccattatctttctttcttctggagtccccgacacggaaccccgtaaaatatccaaggcccgtttggccatcttgggtgatatcttcgccttcacagaaagtccctccggctcctcatacccccgtttaatccaacgtgccgcgcgtcgtagtgcatccccagagataacatcatactgagcctcggtgatacccagctcctttatcatgtcgtctcgttccatatcggggaactccttccgaagaacatcatagtgagcctgagtctccctgatgttcatcttccggcttgggtacatctcctttagcttccggggcgttttcagggccgaccggtcaatcttaccctccagtaaatccagcatcacagagaacatgcgggagcgctccaggccaagcttatccgcgttctcagtcaacctaccgtaatcatcgatatgaaccccgaggaccttttggttcttagacctcatttccgtccccctgctttcttcctggagctaagcttcacgatagcatccgatatagcccggttgacctgggcctcggttaagtgcgaccgctgggcaatctctttgggattcttcacaccctgtgacatcagctccaccacaatatctaccacctgctcccaacgttgaccaacgattatgccccggctcgggtatacgcctttaacagcaccccagtccaactccaccaggccaaacctttcattaccatccagggctcttacgagtgattccaggatgcccttcatcgagacgttatggcgttgtcccatcctgcgtagggtctcgaccacccactcatccagcagtacaggtttatttctggccatcggttactccgttgcgtttaggtatggttattataagactctatacttaagagagtaaactcaccgtttacataggttgataaatgttttaagatagcgttaaatcaaccggagtaaatactatggcttcgataaacttgactaccctgtctgggagaaggattcgtttatacccggaggagatagactgctgcatacccctcgatgacccgatgcggggagcaacgttagtctgggtatacggggacactccagacgggctactgcctcaccacgtgagggaaccgtacttcgacatcgtaagagcaatcatcgtcctgcgcggcgggatataccaggagagaacatgaaagagatatcggctcgagaggctgccgagcgactgggggtaagttactttcagttccttaattactgtcgccgggacaaggccggagtaatgaccaaaggattggtgcgtaaagttggctggggatggattgtgttggaagacgcagtggaggccttacgggatgagaagaccaattgagttcctccacaaagtatggagtcgagtatgtgaggagggtgactatgtattcctgtgctcgaagcccaacggcaagtggagagacaccgcctttaagttcgaccaggacatcaaggggagagtgagggattaccttcgccggaataatcccacagagcaagacgtgtggttctgccccctgccgttctcacagcctgagcgtcaggctcgttatgttaaaccggtcaacattctctggagtgatatagatgacggctcaatcaccaaagtaccgccaacagtactctggaagtcaggaacgcctggacatcaccatggcctgtggttcatcaacgagactcttcaccccgacgatgcggcagcggttaacaggtctgtcactcatttcattggcgcagataagggcggctgggaccttagccaagtcctacgaatccctgggacattcaatcataagaacaagcgcagacctaacccggttacactcattcattggggggagaaggaatacaacctcaagaacctatccaaaaaggtcaagcacatccgacctgaggattttacacatgacccaggcgaggtcaatggtactctggaggaactccttgagggacatcgtctcagtgcacgggttaaacagttactgtgtggccctgcagaggaaggccgacgttccgacatgctttggtacttcgagaataagctgtccgaagcaggatactcaccggctgaaattattgctatcattaagcaaaccgactggaacaagtttaagggccgtcatgatgaggaccgaagactcaagaccgagatggagaaagtccttgaaggacggatggagaaaccagtaaagagaaagctccagcgagctgaagggctcaggattgaatcctttgatgaggtgatgtcttcactcgagtccacacctggttgggccataccgggcttctggatgaaacggtcacatggtttagtagcgggggagcctaagtcctttaagtcaaccctggtgatggatatggccttaagcattgccaccggggcaccgttccttgggaaatatcccgtggaggagaccggacctgtcctgtatatccagaacgagaacgccaagtggattatgaaagaccggttcgaaaaaatggtggtcagtaaaggtctggggggcagtgtagagaagaagggtaagaagctcaggattcgatggccggaagaaatacccttctacatgattaaccaacagaacttcatcctgactgacccagagatgcagtcatacctggaggttaagattaaggagatgaagccggccctggtaatactcgaccctctctacctgatgttcgacggggatatagcttcggctcaagaattattccccatactccaatggctactgtacctgaagaatgaatacaactgtggcatcatcctgattcaccactacaacaaagggggaagcgggaaggagaatgttaggggtggccaacgggtcctagggtcaaccacactgcacggatgggtagagtctgcgtggtatatccaggtagaccccgaatccggtaacggtaaggccagcctgaagcttgaccgagagttccgtggtgcagagccacacaaccggcttgaagtggaactcgagatgggaggtatgggagacaccaagtacgaggtcaacgttcaggactggcaccaggaggaaaataattctcctcagggtcgaggtaagaccgttaaacccgagtcaacggatgatataatgaacttgtttaatacccgtaaaagcctgaccgagaaatatatctcgcagaatacggggttcactgagcaacaggttagagtcctggttgataagttaatcgctgatggtagactgaagcgtcatgaaaactatgtaatccttaacgaggaatataagcaatgattattttagaaggtcctgacaactcaggcaaatccacactgggacatctcttgtcggcttccctggaggttcctcttatccactcccagcggtgtgatacctcgatggccgagagcctgggtatgaccagcgaggagatgtgctatactcacgccctcaaccagctcaaccccgagatgattattcgtgaccggacctataccatctctgaatgggtctacggaaacgtggtaagagataaatcggacatgggtcaggctctgcaccaacaggccatcctcaacctctattaccgccgttacccgattatctactgccgtccgaataacgccaccgtcctaaggaataacggacgtgagcagatgccaggggtgctggaacgtcacaatgacatcatcaaggcatatgaccagctgatggaagagttcagaatcatgggcctgcctgtcatctactacgactggcagaacccaggtgcaacggagtcgattttattgaaggtcaagaaacacttcgatgagtatcgacgtaagaaagtaagtagcatgtatatcaccggagtaagggaatgaaaccaattcaacacatcttcgaacgtcaagctgagctgatgaaaacctatggccacatccgctcctccgtcctgggggagcaacacggtctgccgttttcctgctcacaagttccatcagggattgactggccaaccaaccagctccatatccgagagctggtagggtatatcaacgaagagcttttcgagtccactggggagttcccaggaacgcccgagcatcgggaagaactgattgacgtactccacttctacgtagagctgatgatattctccggcctggactatgagaaccttcacctgttcttgcgtagcacacttccaggagataacgacctgattgaaaccctgtggcctaacggtcagggagtatcacggtctgagtatcatcgggtggggcaggtaatgaacgggttgggggcggctactcactgcctgaagaataagccctggaagcagtcacgaactccaacaaatatggtaaactattaccaggcgctggtcaacgggttccgggagttcctggggctgctatcaacccatctctcctgggatgaggtctacgaccagtatatggccaaggccaccaagaataaaaaacgtcaggagactgcatactaatggcaaaacgcatcagtaaaccagaaacgggaaagctgatgcaacactggtccaacttcgtgttggacctttgttgtactgtacctacggcttatgttcagatacggaagatgtttaataacatcacctgggaagttccctttgacgacttcgatggtattgacatcccaagtgagtctctggcctacgcctcgtggaagtccaaatttcgtcaactggataacaactacctcaaccaagaagagtttgagaaatgcaatgccaaggccgttgaccggaagtccaaaatccaaacctgtgtgactgcccgcttcggtaacaaggaaaagaagaaggagtcgatggggttctgcatgcagaccatctcccttaacctgctcaagcaacccgtggaagggaacccgaagtttgtggtagaggtatactaccggtcaacagaggtgggacagaagttcctggcagacttgaagtacctgcatgaaagggtactcccaatcctactcaaggatatgcccaagcctgacgtgattcgattccggttctgtacgatgtacatgagctcgatgtttctccccatcctgctccagtataccgacccggtcaagaccttcgacgccatagctgagggggactcacactggtggaagaggaccgtgaggcaggccttatatcgttggttacactcgggagaaaacccttataattggcgtacacagaaacttcagtgggagtccttcgataaactggtaagaccgagccttaacgaggaccaattaaaataccttgaatctatagcggagaaagaataatgtacatgttccttaatcccaagcaagccttggaacaaatccaccactatatgaagacccagggccgcctggttcagaccgagcgttggcaggccaaggacatcaagtcaaccccagggtcacagatggttgagctgctccactatcctctggcgatgaagcttccaacggaagacctgaacttctatcgcaaggagctttatccaaatctgccgtgggctgacttccactttgaagagcgtgtctgcggataccccatcaacccaggtgtggagtgggctaactggccttgggctggtaaggcctccgagtctctggattcacacgggcaattcaaccataattatatggagcgatactggcctaagtttgcgggatattccgaaggagttgccacggataccccggaagagttcaggggagaggttctgggggggcatccaaaaacaaaataccaccctaagctgggtctccgtcatgagtatggggatttggaaaatctactttgtctgctccgtaaggaaccggatacccgccaggcatatttccctgtctggttccccgaagatacgggagacgtccacacaggccgcaagccgtgtacgctgggataccactttatagtacgggatggaaagttggacatcacctattacatccgctcgtgtgactactaccgccacttccgggatgacgtatatatgaccatccggttaggcctgtggattctccaccagttgagagagtcccagatagacaacgattattgggacaacgtaaccctggggcgtttggtcatgaatatcacctcactccatatgttcgttaacgactacaccctgctttacaaacagaagccacaaggataagtcatgcgtatcactcgagacgaaatgttaatgatgatggcccacgtttctgcaggccgaggaacctgcctccggcttcgtgtgggggctgttatcgccatagagtctcgggttgtttctcaggggtacaatggtagcccggctggagagccacactgtacccctgaatcctgcaacccgagcagtccttgcaccaggaccattcatgcggaggttaacgccattaactgggccaaagcatatggtataatagacctgagtaaggcaaccctgtacgttaccgatagcccgtgtatggcctgctcacaagagatttacgcggcgggaatcaggaacgttgtttatgaccgagagtatcgaattaggacgggaatcgaatggctattagaaaaaggggtgcaagtatcccagtgttcaataagccttgcaacagttgcgagctgtgtaactttgcgaaccacacctgcctgcagggagtagggaatcagaaagccaaggtggtcatcgttggagacgccccaaaccttaccgaggatagcacaggtaagtatgggcagggtaactcctaccggctgatgagtcaactactcgaagcagctaatatcaaggccgaagacgtttattacgtcccggccattcgttgtagaaagcccgagaacggtaaggtctccgcagcagcacttaaggcctgcaaagaatacctcatcgaggacctgaagagaatcaatcctgagtacgttatcactctgggggcgctggcactgaaggccctcactcgaggaaccaaggttacagaggttcatggtacggtcatccctaccaaggagggttggaagatattcgccgcctaccacccggcgatgtctctgcgtgaccctcggcactgggaggggattctctttgacttccgaatgtttggtaaaatttaccatcaggaggagatggtcaagcatgacctgaagtatacctggattaagaaggcatcccagctacaggaaatcctggacttcgccaagcgtcaaaaggccctgtcctatgacttggagaccaatggtcttaatatgagattgaagacctccaagataagcctgagcgtcatcgggttcctgtctcgcgtctacgttatcgaccacgaaaccatcccacatggtctcatgcggagattctggaagaagctctgtgtgatatcggagggtaaggaggtatcgggggccaacgggaagtttgataacctgtggctgcattatatgttcggttgcaggatgcccctgtcctttgacgttaacctggcgtcacacctcctggatgagaatagtccacaggggcttaagtacaatgcccgtgttcacctggagatggataactgggatgtggacgtcaatgtcaagaagggtaacgtaacgaccccagagcagaaagcagaacaggtgaagtatgcggcctgggacgggtacgctacaatccgactgcaaagactcttccagaaaagactggagcaggacgaggccctcaataacctcttcaggtgggaggtaatgccagccgctcgggaatacgagcagatggaaatcaacggaatctgggtggaagaggaggcaatgaaccaggcagaggctaagcttcgccgtgacatccggagaaccctcaggagtcttaaccgatatacaggagacccggcctttaactggaatagtgctgctcaactcaatgacctgctctttaataagctgggattgaaaccagctggatatactgacgggggagagccatctacggctgaagactatttgattaagatgagagacgaccacccagtcatctcgaccctactcaaataccgggggtacttcaaacagctgtccagcttcatcgaggggtggcgccgccgaatgattgggaatatgatgtacccaacctttaaggtagctgggactgtgaccggtaggccctcgtgtgctgaccccaaccttcaacaggtaccacgtgacccccacatccgctcgctgataggtgctcctcctgggtacacccacttcgagctggactactctcagatggagctgaggattgcggcggcaatatcgggagagcctaacatgctcaggatattccgaagcggtggagatatccacgactccacttatgagatggtcttcggcatgacgccagaaaaggccgtagagcatatcaaggacccaggggagaggaaggcacaacttaaggaggaacgtaagaaggccaaggcggttaactttgggttcatctatgggatggggtggaagaaattccgtgagtacgccgagactaagtatggcctggtgtgtagtgacaaagaggccaagcaaatgcgtaagcgttacttcgaagcctatccagggctggaggtctggcaccaacgtcaacgtcagttggtacatgtgatgtcctgtgtccgtactctgtccggccgcatccgtcacctgccccagattaacagccctgaccgtggcctgatggctgaggctgaacgtctggcaatcaatagtcctgtccaggggttcggtgcggagatgattctgatggccgtcccggagatatcgaactacttcaagaatgacctggtcaaactgaccggtaccattcacgatgctatcacagggtgggtcaaggatgagtacgtgctaccgtgtctccgtcggatgcaggatattatggagtctccagccatcctgaagcgtatgggcatagacctgccactcccaatcctggcggatatatccataggcaactggggtatagggatggagatgaagtccgacgccaagaaagtaaaacccatcgagattgtggatggtgtggtaaaatcggacttaacctgctacctggttaaaaaggaaccggatgcaaaatggggtgaaaccttccaatcaagttcttggagtgaactggagaagaaacttaaggagggatattcacttgtgaccgaggaagaatattatgccgaagatatcccgttctaagccttttaaaataagtcacagtaaggccaaggtaggccgtcgctgtcagaaggcttactactacaaatatattttgaagttgaaaaagaagaccaagtccaggcccctgatgattggttctttagttcacgagtccatcgagtcctatatcaagactggtttctacatgcacaagtttaaggaatttcgtgaggagacctttagacgactcaacgttgaggagcaggcccttaacgctgacatcttcgacctgtgcaagtcactggtcaggggttggatacttcgatggaactctctggggtgggagatggagtgggtcgagaaggagttcgaggtagagatagccccaggaattctcttcataggtaaaatcgatgggcgggccaaagaccgtgagggtcgctcctggctatacgagcacaagacctgtaaacggatgccggatgagctggtcagaatgtacgacgttcagaccccgttgtatatctcggtactgcccgaaatagaggagcctcccgtagtgggggttctctgggattacatcaggaccaagatgccggccaaacctgagctattaaagtcggggggattatcgatgagaaaaagcatcgataccttaccggagatttatgctagggaggtaaaacgccatggatataacttatccgggtatagtgatataatcgactcgttaaaactcaacgaagaaaatttctaccggagaattcaatatccggtatcgaagccccaggccctcaacctgcgggaagagttgatgataacggtgaggtatctgcaggacctggaggagaagggggagtactgcaggaacctaaccagggattgcggatggtgtgactttaaggacctctgctacgctgagctccgaggagatgacactgggttcttaatgaagtatgacttcgaggttaaagatgataaagaaaaaggctccgaaagggatattggcgaaggcgaagcaggtgactgagatggacggtggaatgacctgtcttttctacggtcgctccggcacggggaagaccacactggctggctccttcccaacgcctatcctcatcctggatatgggggagaagggtacagattctctctccgacgttgacggggttaaggtactggagattaactcctgggatgaactggaggaagtctactgggctctggaagacggtagctctggttacaagacggtggtcctggatgctttaccgggagtacaacagctggccatccaaaaggctcgggagctctctcgtaagaaggatggagatatgacctcccagcgtgatatgggggaagccaccaaactgatgcacacctggttatataactaccgtgacctgaagggactcggcatcaacgtagtaatgaacgctcacgaccgaatccgggaaacggactccggtgatgaagaagccatcgctcccgaggtcggtccaaacctgatgccaggaatctccaaagcaatcatgggggcggttgatgtcattggggtaaccttcatccgtattcttaaggaaaagaaaaagattggacagagacaggaaatcgttacagaatactgtctacggatagggccacacgaattcttcaacacaaagattcgtgtaccgaaaggaaaacccattccagagtttattatcgacccaacttatgataaactcaaatccgttatcaaaggtgaatccggggcacctaaaagaaccctccggtctaaacgtttaaaccgaaataaataaggaaacaaccatggctcgtactaccaagtctaaagctaaaaaaactatcaacgttaacttcgaaggcgttgaaagctccggcaaacatcctgaaggccgtttcctggcagtggtcgatggcgctcctgagcagaagacctcggaaaactcgggtaacgactacctgaactggaaattcaaaactccgaaaggttcggtctaccacatgacctccctggcaccacatgctctgtggaacctgaagaacgttctcgaagcttgcggccaggaagtccctgatggcgaactggaactcgacccggctgagctggatggcctggagctgggcatcgaggtcggcaccgagacctacggcggcaagaaacgtgctcgtgtaactgatgtcttcccggtcgaagagatggaagaatccgagaccgaagaggaagaagagactgaggaagaaggtgaagaagtcacctacgccgaagtccaggaaatggacaaagacgaactcatcgagttggccggtgagaacgaaatcaagctcactgccaagctgaagaaaagtgtggatgcactgcgcgaccacatctgctctgagctgggcctggaggaagaggccgaggaagaagaagaatccgaaggtcctactcacgaagaagttcaggagatggacaaggaagagctggtcgagctggctgaagaaaatgaaatcaagctgactgtgaaggtgaagaaaaaccttcaggccctgcgtgacttcatctgtgaagccctcgaactggaggccgaagaagaggaagaagaggacgaagctcccgccaaaacctcacgtaagaaaaccggcaagaccaagaccttcaaaaagggtcaagcggtttccttcgaagaagatggcgagacttacgaaggtaagattaagtccatcaacgagaaagatgccttcgcggtagtagtggtagacggcgaagagtgggaagtcgaactggccgacctgtcttaatcgttaatactcctggttgacaccggagaaagggctctgccatcggcagggccttttttcttgtttaaccttttacttccgtcaagattgttggtaatataactacatcaaccacgaaggagaaacaaaaaaatgactaagcaacagacccgcgactactcagaaatagaacgtatcctggccgcctaccctaatcgtgaagcctgcttcaaccgcctgatgttcgtagctgactccacacctaaagccggtactcgtatccgtttcaccgaagcagcacgtaacctgtaccgggaggcctgagtggctaagctgactaaaatcgaaagcctctggcgcggggcagtcctgaaagtggaaatcgacgggtcaaccgtgtgggttacttacgccggtcaacgtcagctgcttcccacgtgtgggcaggcgttacggtcggaagtctactcactgattaacgggagggctccgggggtaccgaagaaacccggaaaggctccacgattatcgaggcggagcaacaccgctaaatagtacttaggccctccggggcctttttcttaggtttttgacttaaaacatttacagccttaggcgtctgaggtatactaactacatcgggggaacaacccacactaactaaccggaaggacttaaaaatgattaacctgaagaaactgcaaaaattcgttaacctggccctgaacaacgctaacgaaaacgaagccaaagcggctgcacgtcaactgatggctcgcctgtaccgtgaaggcgtcacttttaagccctccctgtttaacctgtctctgtccgacgctacacgcctttacgacctgtctgcagacgaagatatcgaccacgcggcggaagaaacccgtatggctgacaaaaagggtcgcactccacatgagaaggcctacgaaaaggctcgtaaagacgtatacggccataacgaggaagacctggacaaagtaacctcactgaaggacatctgtgaatcgctgaacgtctccgcccaggacgcacgtcgggtactgcgtcgtaagttctaccgtcctgaggctggctgggttttcaatatcggggaaactgaacgggttaaggacatcctgaaaactcacttcaaactggcttaaaacgtttacacgacttcgggggtagtgatacactatccccaacgactatatcggaggacctatgactaaattcctgattacctgtatccaccgcaccgggcacaaatacatcctggctacggctggggaacgcgatatctgcctgtctgacgcctgccgttgggctaccttccacttcggcctgcttcctgacccaaccgccttctgtgtagaattcgaggagtccttatgaaagccactaaaacccttaccctttataagctcctggtcgccgtctggggtaagtacgacgagaccgaaatagacgccgaggaagccacctctcaggcgctggaatccgctgcctgggtactggggggtaaaccgtcatcacatagcctagaatcgctcgcagcaagattcttggggactgaggacctctactggttcctcatgtacctgggtgcccggaaaaaacttcaagaaaactactcaaaaaacatttaagtccgtcttgacctggggtatactagaagcgtcaaccaacggaggattacccgaatgaaaaccttaaacgctaaacaagttcgtgacctggccaaagaatccggcgtcaagcaatactggctgaaagaccgtgccaccctggtagccgaaatcatcaccgccaagggatgggaaaaagaaactgctcagactgtggagttcctgatggctggcggcactattaagcagtgcaaggagcaggccacaccgactcaaacttccagcgctgagtcttctgcgggtaagtcctccaaagaacactcttccggcttcagcaaaaaagccagcacccttattaagtgggtagaagaatacatcaccaacctggccgacgaaggccgactgctccgggagcacctggagtcagggggtcactacccgattaccgaggacaccgttatcttcggggttacgggactgtataacgcaattaaaaccttcggggtagacgcagaccgcgccttcgaaatcaaaactgaggaaactgacgctatggctcgcaaaatcactaaaaccgaaaagaaacctacccgtaaggctggcactaacggcggacgtgataaaaagcctgccacagaatccggtctgattaccctgggcgacctgtgcgacaaatacggggtagaacctcgcatcgcccgtcgtaaactgcgtaacgcgatggctaaaccggaagctggctggaacttcaccgaagaagaatccaaagagatcatcaccataatcaccaaataaaaacactacccccttcggggggtttagttgttggagtagcttatgaaatataaggccaggatagtcaggagaaaaggggagattgaggtcaaagtgtccgctgtcttcacggaggaggaatatgagggaatccagcgtatagctgacgacgtacacgtcaacaccgatacggtaaggggcagtgagtatgacctgagcctgggatacctgagactgctctgttactgggctgagttgtggaataaccgggctaccttcccggacatcatcatgaatgctgccaagagacgtcgtgagctgattaagcacatcgctgagagggcatccaggaaacggaggaaacgcaaatgatactgggaacgggtaagactcgggggttcgtcatcactggcagcctcttagagttgttgagagcgtctcgttggccgggtacggtataccgtgacaccgaaggcgtggtcaggcttcccgagaacgtctcttcctggaagctgttaaaggaacaggagtttgacgacatcacggataaggctcaagccagccttgaccacattggtgaagagtaccgtcggtctcgtagaaacctcaagatagccacccgtaaatttaagaccactggggagacggatattcccgtaccactgaggtctgttccctacgagcaccaggtaaggggctatgggttctgctcacaggttccctcctctggactgtttgctgaccaggggacggggaagtccctgatggctattgctgtggctggaagacgttacctggacggtgaggtcacacgggtgattgtagtcagcccaaagaacgttaagcccgtgtggcccaatcagctgaggactcacgccgggtacgagtggacggcctcggtcaataaaaaacccccggtaggtcctgggtgcttattctgggtgatatcctatggggaggtaaagggactgaccaaggagataaggaagtggaagcccgagatgattattggtgacgagtcacaccgcctcaagaaccgggataccaaagcctttaagagcttccgggatgcctgcataaaaattccgtatcggctcctcctaacgggtactcccattgggaagtgcatcagtgaggcttggtctcagttttatatcatcaaccgggacctcttcggaagcttctctgccttcaaggaccggtacctggtcatgggaggctatatgaactactccgtggttgggtataaaaacgaagaggagttttacgataagttccactcgctctcattccgggtgaccaaggacgagtgcttggaccttcccccggtgagctaccaacgtatatacgtagaggccagtcaaaagcttcgtgatcagtatgaccacttcgctagccagctgttcctggacaccaagagcggggaggtcactgcacccggtcaagcagttgctcagatgaaactccgtcagatagcagggggtacggtcaagaccgatgatggagtactgtccaagatatcaaccgtcaagttatcggccctgagggaatttcttgaagaccggttaaatgacaagaccattatattcttctccttcgttcatgagatggatgcggcggagaagctatgtaaaaatcttggcataaagtcccttaggttgtccgggtctactccacaggggcagagggatacgtttgaaactagattccagggtcacacaggcccttgtgtggccattatccagtgtactaccggggcggagggtttaacgctacacagcgccaattacgccctattttactccccgtccttctcctacgtggcctacgcacaggctcgggataggattaatcgcatcgggcagaggagagccgtcaccatcggcttcctgattgttgaaaataccatggacgagagagtagtagaagtcttagaatcaaatggtcaactggttacgaccacactcgacgacaatcgacattataaactgaggaaacaaatcatggctaagaaacccgctgccaaagctgcaaccgaaaccaagaccactgctaaaaccgaaggctacaacgctgccgccctggccgaagaattcgagctgtctccggctgacctgcgtaagcatctgcgcgcactgaaaatcgaaaagcctgaggctggctgggtctggccgaagaaaaccgatgccggcctggcggagattcgtaaagctctaaaggagcgcttgaagtctctggaagcaaaagccgcaggcaagaccgaagcaccggccaaagcgaaagcagcaccgaaggcgaaaaccagcgaaaaagccgcaccagccaaaagcaagaaagcttctgcgaccaaagcgaagaaagcctccgcagcagagtaagctggcgggttcgccggggagaatccctaacgctggttaagatgcgtctcgatggaagaaccgtcgggacgttaaccggaaccgaagaagggattggccggatgaaggaaagactcttctacggccatttccatattcccgaaccgaattctaccccgaccaaaagaaaacgcaaacggagagcttaggctctccttttttgtagaggtacttgatggaacccctgttgtacaagaaattgcttcgtgcatgtcccaagcctaagttccactggcaacgtcatgaggataaactggcgagtggaatcgccgactgctcatatgcatcacagaaagtctgtgggtgggtggagctcaagacgtatgactcatggcctaggaaggcggaagacccgatgaacttctctgacctccagccggagcaacgtaactggctcgtagcacgtgggagggcctgcggtagggtttacctattgcttcaggttaaagatgactggctgctcttacactggacttcagtaaggctactgggtagtctcacgaagcgccagctgttcatccacgccagactatcgggtaagggtccaatagacaaagtaatggctgacgttttagtcgaggaggcttaatatggaaagcataaccctggagagactctgtgagaagtcggagggccacaagtggcatggtcgggttaaagctgctgtagcggttttcggtaaggaacgtagggtcttcgatgatggggtacttaccctggaagagttcaagaaccttcactataccgggggccattcgctgtccttctgcgtgggtgtggctaaggacatgtacaacctttaccaaaggatacttcggaatgaacaggcctaaaccacacgtcatcttttatggtgggtattggagggtttcactctgcccaagcagaaaccaaaaaatattagctaattggcatgctgtacatcggcacgttcaagagttcaaccggggagaatcccgaagagaacgtctgctaagggcctgggggtgtgagtgctccaccatagactattgtgacttttgtctgaggggtatgtccaatgagaatactggctagtcttatcctgattatcatgtcttcgtggtttctaatggcagcataccagaactacaagatgttcgtccggttcccgccgtggttaaggggtcactacttagcccggtactatcaggggcagtatcgaagggccttgctcaaatgctgcctgattgcttttctctctgttgtagtgaggtacctatgataaccgcagcacaggcccgtatactggccaaccgaaagtccgtgtcttcccaagctcaaagttgggtgactcgttctatccagaccgcagccaccaacggtaactttgacgttacctgctatcacgataatttttcaagagcccattcaactcagcacctgacaactgaggagtttctgggtatattcgagaacatagccctgaagctctcaaccctgggcttcaaagccgaagctttcccaaacaagcttgttatcaggtggaacccatgaagaagttagtgttaggtgtggtcctggtattaaccgcccacactgccgaagcaaagaaccaactggcagcttttgatattcaagaagatgttaaatttatctgcgccaaaagcgatagcccccaggactgcgaagagcttttgatggctcgggttgaccaggcgatgaactggtctttcgtggcaggtatgtgtaaggccggtaagctgctcggggcagaaaccgggaacaagactgactgtgctaatgcgtccggtcagtatcgtgcaatcaaagccgtaactggaggaagtgaatgaagcttttaatgattgacatcgaagggatgaacttggtaccacacaagacccgaatcatgcagctgtcagcagcgttctttgacgagcagggcaacatcgaatcggtcttcaacgagtttaccggtaaggagcctcacatgttcccggactggacggtagacgacccagacaccatgaagttctggaaggcccagccaacctgggagaagatggttggggccatggctatccatggtcggtcttatcagtcggtgattaagtcctttcgtgagtgggtactctcccattctggagaggagagaaccctggtctatgcctgtggtcctcagtatgatatcacaactcttgatgaatacttccgtcagctggggtatgaggctccgtggagatactcgggcgtccgtgactaccgtaccatccgtgagcagtaccatgaccgaatcggggatgtggagtatggagaccacatggcacacaatgatgttgtggctcagattcataacttagttcaatgcatccgtgctgggtatgtgccagcctaaggacttggtatgacttctaacgaaaagctattttgggggttactggtgttttggggaatcgtggcgggagcgattgggtggggtatctggggataaataaatcttgacttaacggccatacagcgaataaaagcggggagggtatataaccctatccccgcttaattttgattaaaccttgctacgcctcgctcggtatttgattagggaatcgtaaccccccgccgggccattagggttcgggtatcgttaatcagctgcgcacgtccccccaccccgtagtcacccgcgtacatagcccacgccccgatgataccgttaggcggcagacagatgcttgcggcagcaggaatcttcgtacccccgatgcatgtggtggctaccgcttgacgtttagtcaaggtttcaccagcagtacccgtaaattgttgaccggagcttctctgaatggtcagggtcttaccgctaacagtataggcgtaggctgtccaccccccataggcatttccaccttgaataaaatagctaccgggggtcacaccgattgagagagattggagaccagctgcagttaaagcgaatcgatgccccgtgaacggtgaagtaccttcgttaagagcagaggagatggcggaggtcgcggttggttgagccacgttgtgagcaaccactacggtgaagatatcgggttcgaggattcccgtgtcagcgaaatatccttcaaccggagtacataccatcccctgaggaccaaacgtatgacctcccatagtcaggtggttctcatttcccgactcatcctgaggaccgagcagactgtaaatccccaaagcgtctggacgagccaacgggttggagaagtctccgataggcaggttagggttgttgaaactcgaaacgggaactaaacgaatggtcatgctgtcacctctactttatggatacaacagaagttgtgtaatgggtatggtttcccgtaaggtcccatgaggtctgttacctccgggtctgagtcacagatgttagttctcactcccgtgattggtccaaagaaccagtcaggccagcgattagtggccgggtcataggtcccccgattctctggagtccaggctgtagcaaagaaggctccttcgccaatatcccggtcagtggttagcttaagctgagttccacccacgatggccacactgagtacggttagtcttcccgcattatcgtgaatctcagctcctttcatcccgtccgtcaggggggtgatgttttcctcatcaaacttcaacggaggaactggaacatgaaagtccaccagcatggttctcgggttgattagccgagccttagttgggtggagggggagccacttctggccggtcctcatgcgataacggagagccttctggaagtacagccccacccatcgatagccgtgggaggagtggtggacgttcccagacgtagtagcgtggggaccatagtaggtaggacccacacagtcaatgttcgggtcggtcagggcaagctccaattgcccacgtgcaatctcctctgggggattttctggagtaccattatagtacccgtgtgaggaggtctggtaggtcaacatcacaagaggcttacccgtctcacggtatccagccgtgtcggtctccagctcccccctcaggccggtaagatggttttggtaggtgagcttgttcatcccgtcggccatgttggcttcaccctgaagccagaacatatagtcaatgctgtgattatacccgttggtcaccatctgggtgtgagcccagttgaattgggctaacgcagcattgtatggccccgtccctttcctcaggttttgaattctctccccgttcacccctccggcattcatcaggagcttcctgccgttcatgcccccgctcttcttagtgaactcgtaggagaaccccgaggcgatagtctcccaggtggcctcttttaagtccacgaagctggtgggtatccccgagtcccgagaccttaccccagtgttatacatcagggaatcataggtaggagtgttgaggataggggtaccataagccccatttgacagagactgtccgtagatgaagatgtggagacgttcaacgaagtccagcactggagttggttctggggtagaacctgtgtcgtagaccgtagccacaccgctgttggacagagacatggccatggccccggagtcatcagttacaaccacacagttaccgctgaccgactctttgtagagtctcatccccagcagctcaatccatccggccttacctatcccaaagaccacagcgtcgttgtcatcggagaagacgaaggcgtactcagactcagccggcagcggggtgaatttgttggtcccgaggttgaacatccccgagttgaccccaaagagcccctgcttatcaaggaataccgcaatctgcttagctgccgaagcaatctcaaaggcgttagttccccccacgttatagatgcccgcgcttatcaggaggttggcggcgttagcatctatgcgagtgagttgagccaggtaccacaggaagttagggaaaatctttggcttcccagaggtatcaagaatggtttccagggttccgttgttgttgaatttgaaagtgtaggccgcgttggggtctgtgcctactactgctaccacacctccgttggggatagtgccggctgttatggccgcctgagcagcagcatcgtccttataaggggcctgaagcccagcagcattctgcgcggattgtgcagcctctagtgcagaacgggcggcttcctgagcagctgtttgagcgtccagacgagcctgcagaacctgttgaagaatctccggagtaatttcctcctctccgggaatagtcaggaagttctccagggttccattaagggagtccaccagaatggtgatgtccccgatgtattggggtccataggcaccaaaattgatgtagagagcataagcaccaacctcgagtgggaagttgtacgttccctggagagaggtgtaatagtgggcgatggactccacgatgacgttggcagatgtcttcttagccctgagctcaagctcagtattgggaagaacattctgcatcccgtctttgagggttcccgatatagtaacggccatgctggctctcctgttttaaccaacgttatggattggggttcttccctttttatagagagctacccagggttcttgcgtggtgtagtccttaacgaaggaggttcctgggaaggagccacttgtgtttgggaccaatgtttgaatattaagaggaacggtgaggctcacagtagccgggcggttttccctgacgtggacaacgaactggttcatcactgaacggtctcccgtggttggcactgtgatgccctccatggtgaagaacaaaggactattctccccaccgttcccggtatcgaatgacccgataagctggtctggccttcctggagtcctgatgtaaaggtcaaagtattgacgttctgaggagctcatctgcatgatgagattcgaatccagtacacggtcaaactcttcaccctcgatgttccacaggatatggtctccagccgaaccccagttgaaggaacccaggtctatgcctccagacatcttgttataaatatccccaacgatgttattggcatagatagtacccaggaagtacccgttttgagcgtatatgtccccgtagtacttggactcggttggctgggtgaattggagctgagcaatacccgactggatattctccttgctcacagcccttacctgggcggtgtaggtctgtcctttactcaatccgttgacctggacctgagtcccggtgacctgctgagagaatagggtcttgtcacctgagtagatgatgacctggttgtatatgaccggggtcggattgacccaagacagaaccccctgccagttaacctcatccccctcagccacaggggtaaatgccaggttagtgggtgtggctaccgttgggcctggtaagtgggtcaggtctggtcggtcgatgggctggccgaccgagtcaccccaaacgtctgcggtttcctgtcgaagggtgacgttgataccaccttgcggctggagctcccatttggtaacccggaactcctggttaatgattcccagggacggtatattgacgttaacgtagtaacccggacggtactggtagccacagaagtttaagggcatatcgagggttctaccaagacgcttacggttcagcttaatctgtaccaggcgttgggcctgatagaccgatgtaacgaaccggaagtcttggtcttccccgaactcgttaccatcctcagcaatccaggcagcgattttaaccgctgggaagtccgtctccacatatccctgctcggggtcgacaaaggtacccgtcatcatgtttatcttgtctttccaggaggtctctggaatgattttgatgttgtcgatgatttgggactcagtcaactgcatagtagcaggcccgtagtaagccccggctagcatcccgtgtctaccaccgatgtaggttggttctcccccacaggtctcgtgcatatcatccaggacggacgccatcgactcatccaggtcaatggcaccattcaggcgatatctaggctcattgtagatgtccccggagatgttctcatcgcagatattggcggcttcgatgaactcctccatgataaggtctgagtccagtaccccgagcactgaccggtagaagtccaggatgcacaaggcgcaattgtcagtccactgggttaggccacttcgggggtcgaagcatttacggccatagacctcacacttgaagttcgggatacccgcagggaacttctcctggtcgaacttcagggagaggcgaatccagcagataccccggccaatcatgtcggtcttccacgaggggcatttgctcagcatgtaggggtcagcggtagtacggttgttgtgtacctcgtaggtaacgtgctccccgtagtcctctatccggtcatccccaagccacatagctccaatgtggtcaacctcgtgagcagctacagcaatggctaggtgaacccactcatcagtatcctggtctccttcctcttcttcagcgaagaacagcaacccagacaccacagtctttccatagatatatgtctgggctgccgccgaactccgtagaacctgcttcctttcctgcacagatgcgtatgcccccacggatggaacggaggtcttagttaacagtgctccggccagtgtggctgtagcggtaatgaccaaggcggcggtcatactaataatcccggcagacgctgcggcagaagccccgatagcgattgcaccggctataattgctggtggcatcttaaaccctccaggccttcaagatacggtccttgatattgatgaacagctggactccctccaacccctgaagccacaccgattggccagcccagtaaattccaagagcagggccagcatcggtctggaccataaccaagtcacctcgctggacgtatggaatgtctacctgagcaaacttcccatccagtactccagttagtccatcttcgttggccttagccaacagacgcttagccccaatctccgtggaatatttacccctgaactcagaggcatagtccacaccagtcatggccagcactacgtctgcggcgaagagacagcagtcatgctttccccattcgaatttgaccttctcacgaaggactacctgttcgagtaacttgtcttgccagtcgaggttcttcatatgcgggtcctattcgtaggtgaatccgggagcatcttttttggagccccagtatattgaccgctcagacatttggcctacataccggaaaatcctgtctccctggttcagttgcttctgtgattcatccgtgtatctccagggcttgcccttagaccactcctggaagatgtttgacacggtgtaagtaagagcaccctcgtcaccagctaccacagcagtctgggtgattttaccccggtagataacgttggaagctatctcggtgtaggtggtgtcgaagacagcgatgtaacagatgacctctttgccaaccaccttttcgttgagggttatactgagcagctcgttattcaagccggtcagagtaagctgaaccgatgtgggggaggtactgttctcctcagtaacgctgctcacgttaccaatgctccccaccccatcgaatacctgaccgccaatcatgatttgacccacaccggtatgaacccgagtgatgccagagtcaaaggctatctcaacggccaaggcaacgataacgttgggaaggctcatggcctccgcaacggtcatgcttaaaggagcactaatcatgtgtagaaagactccacgaaagagaggttgaagtcattggcgaaagcaggctttctaccaaccccattctcatccttatctaaccggaagactccacggggattagccacctcgatgggagattggtggggtggactcttccttagcatgggggcgatatagatagagcaccacccctcatcattggatactacgtcatccagaaccatcttaagttcatcccccacgctgatgtaatctccccgatgcagcactaccctatttctaatccaaccccgagtgtctatcttgaaccccgtctggttggccccgtccactactggagctcccacaggaggtctaccgtaccggccaaagtcggggattctgatggtacccgcccgacccatctggaagataagggtctccaggtaccgggattgataatcatccaggtcctgaaagaccagctcacacttccacatgctgccggggtaggttactgtctgggttgagccgttgaacttagactggaagatggaaccgttatccttcaggttccaatccatgcttgcaggccttaagatgttcaccggccaatctagtgttgccataattatctcccgattgcccggctaacctgtcccctgctcccggatacatccgtaagcaccattgcgtaaccctgttgagcaccctgctcagcggcctgttgaagcagacgttgaagctgggcgtcagtgttacccgtgatttggaatgtctgatgaatctgaggagcttgcccttggccccctccactagacaggaagttcttcaagtcggcgttggtgcgggagtcaaccacacgttctcctttatccagtaaccacgttccttctcgaggtatctcgtctataccatcgtgagccatacccacagcagcaatggaagacagtaagctgccccctgctgcggcgattgccgccatgttggcgaacttctgagccggggtcaatgccgtagggtcggccattgcttgggagatagccgtggagaggttaagcgtggcctgtgcgatggagaaggcttgggatgctgcgaagagaaccttatacgcactagaaccctcagcgccagcagccttgataatatcagccatacccttggccaacatcgacccagacttgatataacccattacctcggcgttctcggcctctgcctgggcctggagcatctctgtgtagagttcgtgtctacgttgggcatagtcttcctcagtcacatatcctgcttccaggtaggcctgcagagcagccagttgggtatcgtatatgttctgagcctcctgcacctcgtcatacttgccccgcatcttgtcttccagactaactgcattatcctgctcgagctgaacctgagcgttgaagaagtcttcctgcagtcggttacgagcagacaggctggcctcttcagtaatcagtccggctttctgaagagcctcgatttccttattggactctttctgcttacgagctgcagcagcggctgggtcgtacttatccacgatgtccagacgggccttaccgtacttctcgtgaatggcgttggtagcagactgagcctcttccgtggaagccacaccagccttaaggtatttgtcaacccggtcgaggtcctgtttctccttgagggccagctggtcgaacgtgtccgagccgccttgcaggatggtctggtaaaacgtctcccaggaatccgctgtaagtttctggcccgatgccccgcctttcttcccgcccttagaggatgagttgctaccggagttatccccgcccacacggaagccagctaatcggtcttcagtgggcttcgtcttattggcttggtcagtggctttctgctgaccaaccatgacggctatgtccatatcagccagtttctgctggcgtttggactcagcttcgaaggactccctattggccttttcctctgctgctcggatagtggccttgttattggagatatcctggtcgagcttcatcttggcgtcagccacacgtttggctacctgggtttcccaatcagcatctgccccgatggtcagggccgatttgaggtaatccccgaacccagagacgtaggcgtccaataccttgaactgaccgataatgtaattgaccagcatcttaccatactcggagccgtaggtagcccacttctcgagttcaattcttgaggtctctacgaagttgatgatgttggctggaagctctttgaactcccggatggtgttatccatcagctcctggacatcagccatgaatccagtcttgaaggacttcatctcatcatcggtcaggtgaaagaagtcctgtactgcctggcctaacccgtcccactgttgaatccattccgtggtaacggtatcgaactgacctgaggcgaagatgtcgttcaggtcctggatggaatcacccgcctgtcttacctgagcagtaatgaagtcaccgataccagtcttgctgatattgagccatagcatgtcccagttatcagacaggttggcgaaggccccatcgagggtcttcatctgctcagacatagctgtaccgaagttgttctcccccaactgaatgaggtagttttcaatctcagcagcattgttcttgacagacgttgtggttccacggaaggtaaaggcaatggtgtcaccattattcttcgccttgataccaaattccttcagacgctcaaactcaccagttgctgcatcagccacagcctcaatcatctggtcgagagacttagacatagaggaggctgtgttgccgtaggaacgaagagcacgttctgagggggtaagcccgtagttaacgagcttcacgaaagctgtggttgattgctcgagaccgaagggggtctctttggcaaagtcctgaagcgcctcgaatgcagcagctgcgttctcagcactaccggtagcaaccttaagctgggcgttgagtatgccaaactgtcgggttacttccgttaccttgcgaagggatagcagagcagctgctgctatnn

SEQ ID NO: 9 - DNA, 38609 bp, Unknown
  bacteriophage genomic DNA
acccctgccgcattgagaagcccaaacccaacgcccgcccttgacctgaaaacgcccacgcggcaaactagccaagggctagaataagacgattcttagcgcggcctggctaacaactaggccgcttttctttgggtgatgaatggtgctagtatcagcacataaaacattcattgaggcttgcgcggtatgggcgatcataatgtgagtgatgcaaaaatagaggtacttgtagagcgagttaatagcgctatagaagatatttcaggattaaaaaaagatttaaaatcactggacagggctttagaggtgattatcgaatttagaaaggatgcggagcacatcaggcttgatgttgaaaggctgcataaatcagtaaatgataatgaaaaaattctcgttgaagttgtatcaattacaaaacagcattcatttatctggaaattaataggcggatgttctggtattttaatattattaactggatgggttagcggccaattcacatcgttaagcaaaaacgataacgacgttgataaaagggtttctattcttgaatatagaatctcaccgcatgaaattaataagcaaccaactttagaaaaagaggtaacgaaatgaaatttaatttagtgtcatggcgcgcaaagtggtggaaattgtggagtatcagattaggattaattggaaccgctttaagcggtttctttctttattttcctgatgcagcaattcatgcctgggcttttctcccggctgatttaaaacaggaaattccaccatctttgcttaaattgattgggccggttatttttattatggccatgatttcccagtttattaaacagcacaagctggaggataaaaaggatgattaatccagatatcaaatgctcaaaacaaatggcaacatttttatatatgttgagtgttagcgagctgccgttaagcctggcaaacgatcctgataaatgctatcgcgttaacgttggtagcaccgatagcaagccaattcttttcgatagctttaaaacccatcctgggatttcaatttcttttccaaagcttggaattaaatctgacgccgccgggcgctatcaaatcatgggctggatttatagggcgtatgcaaaaccatcacaattaaatctccctgatttttcgccgctatcccaggataaaattgccattaaattaatcagggagtgcagagctattgatgatattgaagctggtagaattaaatcggcgataaataaatgtcgttctcgctgggcctcgctccctggggctggatacaaacaaaacgagcatagcattaatatgcttatcgatgtatttaaaaaagctggtggaactgtaattgactaaggggattaaaatgacaagttatctagctgtaattggcgcgggaattttgtttttgttttctttggttggctccttttttgttggaaaaagtaaaggaaaatcagccgaacaaataaaaaacattgaagaaaattccaacaaagaaattaaaattgctgtcagtcaaaacaaagaaagggtagaggccgtaaatgatgcgattaaaattaaagatgatgttaaccgccttgacgctggctccgctgctgacaagctgcgccgggactggtcaagagactagccagccgcgcaccatagacacgtcatgcgattgggtaacgtacatatacatcagccgccaggactcgctaacggacggtacagcgcgccaaatcctggcccacaacgaggctctacaggcccgctgtgagaaaggcatagacaagccaggctaagcggtgatagccttactacgcgccccctgttgcgcgctcggcaagcccccggacaaccctaaaaagtttccgggggttttcttttgcctgtagcttttaagtgttgacatgatgaatatttagaattatatttaattaaattttaaacaggatttaatcatgagcaacaagcctttaattagtaaataccaacgagatccgggtttgcttagcggcgaacagcgccgagccaagttaatcaggttgatgagcgccagcggcttaacgtctgttgatattgcgtcggcaattaatcgcagggcgcaaaccgttagatgctgggtttcagcagagaataaaagaaacattccacttgatgcgcttaatgaagtttatatcgcatttggctattcagttgatgaggattttccaattgcctagcttgcctaaaaaatcttgccgggtagttagctgccccaacctggcaacctccgccaacaacggctattgcgtagagcataaaaacaaaggctgggaggattaccaggattcaaaatttggtgaggttagagtttaccaaacagccgagtggaagcgggcaagaaagatctgctttaacacctatcatggtttatgcgcaaatagcgaaaagactcacggcattagacgcggcaacaactgcgatcacatcattcctttatcgcaaggcggcgagccatactcccaatcaaatttacaaatgttatgcgatgagtgccataacacgaaaacagccaaagaaaaagcaaaatcgaaaagttcgaaaaattgagcttcaatttcccgcgcgcgtgcgttgaggtattcagacgatagcggaaagaaaaggtttttgtgattttcctaccccctacccatttttttaaaatgccgggggataccccctaaaaatgtcaatacattttgataaatattttttcaaaagaggaaatcgaaaatgaatatcgaggaagcaaaggtagtgatggacgtcattaagcatatggaggtagcggttaacggcgctggggtaaacaacaattatatccgtgaaggtattaaatgcatctatcgccaaaccatagataaccacgttgtatgcatcggcgcgtatgacgtgaagccagcaaccattaagcacctggcccagggtctggagctaatcccaggaattaaaaccctgagcggtcgccctaatcccattgatgataattggcctaaggctggcgctaatcctgctgttgctgttgttgatggacaaccattgtataaattaaatcctggtgagacttttacgccagaaaaagctaacgatgattttattaaacaattagtgcgagaagaattatcacgcgtgcttaatgtctctaagcacatgctggacgattgcgcgatagagaataaatcaatggttcctatctggttttacaataacgtcattgctgcgattaatgccgacaacgcaaataaaagcaatgatgatttagtgatgccagatgataatattccaccacctgctcctaagtttaatttagaggctactgtttacggctgcataaatagtcgtcctcatgattttattaagcgttcagtaccgccgcacggcgatagtgttatggtttgcagtgtatgcgggaagttcaaccccaattcatgcgagcatgtttttaattccagccttgataaatcttatcgctggtgtatcgggtgtggtcatattgaagatcttgacgaaaaaggctttttcccaaaagataaataatgcctataaattggagttagataaatgaaaaaacaacgtccagcaagaaaagaaagaatccgcatcgctaaattcatgaaaaaagaattaatgcgattcggtatgtcaaaacgccaggccatcggctatgcctttatttgtgcgtattacgcaatgaaagctgtggaggatttacctaaaaaatatcagcgccttgatgtttgcgatatgcggcaatacatacaggatgaggtttcttgctgggatgccatttagccgattgattggctggtaaattgtgatatattgaaatcgtcattttgacgtagatttaatctaggagataaaaatgaaagagctagaagatcgctacatcgtcgtaaaaaaaaccgatgtggaagatgcattaaaaaacatggcatttacagaagctgatttgctgggcttctatgccgtggttaacgtgctgaaagaaagccgcgcgtttgagggcaagcaggatttgacagggatttttgttgaatcagattggccttgctttgaaaccgtcaaaaacctggtgctcggcggtgatgacgatgcgtaaaaaaatcgtcgccattttaatcagcgagcattaccgcaagttgcgagagtggcgagcggtgactaaggcccggattgccgttaccattaccggcatgattaacggcctgtcgcgctctgaggtcaaagccattgccgctgatcttgttgatttagtcaagcctaacgcttatattagtgatcaaaatatcattgatttaatcgaggcttggattcatggagacattaaggctacaacaggcgggtgaggttttaaactccttgcgtgaaaatggctataaaattttccttgacgctcggaataatccgggcgtttttccgttactgcatccaactagttataattccgttatggcttttcgtgatgaattgcgcgaattattaaaaaaagaaaagggggaataaatggccgggcgcgtaggggttccattagcaattcatgatttgaagggaaatccttcaaaattaaatatgaaggaagaaaaagcaaagcaggcaaattatccaccacttgcccccgatgctcaaccgcctgaatattttacagcagaagaaaaacaatattggcttgagcttgcgcagcgatttaatgcgattaaagttttaaccactatggacacgatggcgcttgagcttttaatcaccgcttatggtgaatggcgtcggcaccgtgattttttgagcgtgcgcggctatagctacgaaactagcaccagcatgggcgacacgaaatataataaattccctgaggctgaattaatgattaatgcctgggagcgtatttttaaaatgctgcaacaattcggctggactccggcgagccgtagcaaggttagccctatctcagatcacaaggctgatttagttcagatgtttactcagtctggggcgaggggtaaataatgtcggatatggttgaacaaaatacaatttataacgggaatgattccgttattgagttgcgtagattttgcaaaacctacgataacgggacggctacggttgagcatggcattgaatacgcgcgcgatgtagtagaagggcgcgttttggcttgcaagcatgttaaaaacgcctgcaagcgatttttaaaagatctggacagatgcaattcagatgaatgtgaaatggaatttagttttgccagggcgcagcatattttagattttgcccaaactttttgcgttcacgttaaaggacgcttgcgcggtaagaaagttgatttaatggactttcatatttttattttaattgcaatttttggttttatcgtccctcttaccgatgacgaaaccggcgactatgttagaaaagatgacgtagatatttataacgagcttggcgtttatctatatagcgagcctggcgaaattgtatgggttcggcgatataagacagcagtaatttttgttgcgcgtaaaaatgcaaaatcattcctggcgtccgtgatttccctttacatgcttttctttgatgatgagggcggcgcggagatttattcagccgcaacaaaacttgaccaggcaaaaattgtgtatgacgacgcaaaagaaatggtggaaaaatccccgctattaaaacagcatttgcaaacagcaaaaaaatcaattttccatattccctcatattcaaaattcgtccccctggctagcgaggctgatagccttgatggtcttaatattcatcttggaatccttgatgaaattcacgcatataaaacacgcgatttattcgacgttatcgaaactgctaccggctcaagggatcagcctttaattctttgcgtgtcaacggctggcgtaatccttgacggcatcgcaaccgaattatgcgactacggaaataaaataaatgaggggctggttcctgacggtagcggcgattctttcttccagattttttacacgcttgatgatggcgatgatgaatttgatgagctggtatggtttaaagcaaacccagcgctaggcaaagcaagaaaattatcagacctaagagaaaaggctgaaaaggcaaaagagcaggtttccgccaggtcaaactataaaacaaaatatatgaatattttcgttgctggtggcgaatcctggatggacatgcaaaaatggcaatccatgagcgttgtaaatgccgctaagtgtgaatattttattggcgttgacttggcaaacaaaattgacctttgcgccgccacaaaagtttatcgtggcaaggctggcgcatttaatggtcacttagcatacgaattaaaattatggctacctgagggcaggctaaaaacttgctcaaaaatgatggctgaaatgtataagaaatgggcaaaattagggcttcttaccctaacagaaggtgacgccgtggatcatgaaacggtgctaaatgatattttagaatgggttgaaccaacaaaagacctgttgcaagaagtcgcctatgattcctggcaggcaacgcaatttgctatcgccgcgtcggctgctggcctgcctatggtagaagtcacccagaccgttaaaaatctatccgagtctttaaagcatgtagaaatgctggtatattctaacaaattccaccatcacgcccaggctaacattgcgatgaattggatgatgagcaacgttaacgtcaaggaagataaaaacgagaatatatttccatttaaatctgggcttgaaaataaaattgatggccctggctcgctgtttaacgccgtgtcacgaatcattaggcactcaaaagaattcgtgatccctgtaatcgataaccctaccgggaatttataaatgaataatattattaacaggatttttaataaacaaaaatctcagccaattgaacgaaattcggataatgttaaagttttttctgaatcccgttctggtgatgatgtgccggatatgtccgaggaagggacggaatataaggttgttgattctgcaaccggcgacatgtcgctatggcatgaaaacggaaaaacctatgtaaatgaagaaaccgccctggcgcttgccgctgtctatgcgtcgattgaccgaatttcagcggcgttagccatgattcccatcagcgttattaaattaacggatggcgaatatctgccggttgataatcaccctgtttctgattttttcaaaacagatcctaacgatcatcaaacatggtacgaaattatccgcgcctatattgttgacgttctttctgatggcaacggatatatttttgcagaaagaaaaaagaatcaggacattattcaatttaaatggttccaagcaacgatggtggaattgattaatgttcgtcgtaatgtctggatgtatattgccgtagatgatgagggctattcatatacaattcatcctgatgatatgatgcatttaaagcaccttggaaataaaggccgaaaagggctgtcccctatccgcttgcacgcggaattaatcgggatggggcttgattcccaaaaatacggcgcgtcattttatcagtctggtggtaagccatccggccttattggcgcaaaaaatgtcacctcagaagtgtctatggaaaaccttcaaaaaacatgggaacgcgcgaaagcaaatacccaggatggaaaatcaagaacaattttcctcccggcagaagttacctatacgccaatttcaatttctccaattgacgccgcacttgtgcaatccatgaaattaacgcgtagtgacgtttccggtatttttaacgttcccgcctacatgatcggcgatttggataaggcgaattattcaaacattacccagcaggcaatttcatttgttacaaataccttgcagccgtgggttacaaatatcgaaaaagtatttaataaagttttatttacccgcaaagagcgcctggccggtattagtgtttattttgacatggacgaattaatgcgcggcaccccatcggaaagggctgaaatcgcccacaaagcgataacagacggatggaaaagccgcaacgaggttagggtaggcgaaaagatgcgtaaagttgctgggcttgatgaatatctcgttagtgttaacgcgtctcagccggtagaaaataataaaaataacgttgacacaaacaatgataaacaggaaaataacacacaaaccgatgaggataagcaaaatgcagaaaccgaagaataacgagattgaaaagcgcagcatttcagggcgcgtttcattgtcggaaaccagggatggagaaggggcggcggttgattctaatccggtcatcagtggttatgcggctgtttacgagcagccgtctagcgatctctggtggattgaaacaattcggcgcggtgcttttgataacgcagattttagccagtgcttttcgttctggaatcacaacgaggatgtgattttgggttcagtccgcggcggctccttgcaagtcaaggttgacgaaaaagggcttttttatgaggttaagcctgacgctaaaaattcatacatcgatggcgttgctttatcgcctatgcgccgtggcgacgttacccactcatcctttagatttatcgaggttccaggcactagcgaatggcgctgggatgaagaatctgatattgtttacaggacaatcacgcagattgcgcgcgtgcttgatgtttcgccagttgttttcccggcatatgatgccgccgattcttctctgagaaaagcagaagaattaagaagtggcgcgaataattctaaaatggcagaaatcgccattgaagatttaaagcgcgaagatttcatccgctctattatttaataggaattaaaaaaatgacgcttaaagaaatgtatgcagcactgaaagaaaaacgcgcatcagcagttaaaattaactctgaaatgcgcggcaaacaaccaactgacgaacagcgcgcagcttgggaggccttgcaatcggaaattgaaattctttccgccgatattctgcgcgaggaagaaatccgatccactgacgccgtgcttgctgaccaaatcaacgaaaccgcgccagcaaaaacaaccgaccaggaaacccgccgcaataaagcgcttaacgcttacctgcgctccgggttctctgatatgccagaggaacaccgcgccgcgcttaaagagctgcgcgccatgaacaccacctcaaatgcagacggcggttataccatcgacacccaaacgctttcccgcgttcaggagagtgaatactcttacggcggtatcctggcggcaactcagccgctgccgaccagcaagggcaaccctattaactggcctgtttccctggaaggcgcagcaaaaggcgttatcgtcggcgaggaacaaaaccacggcaaaaaatcaacacaattcggccagcacgaattaaaagcgtataaaatctccagtcaaattattttggtttcactggaattactgaccgattcagaaatcgatattgccgcatacgtcacccgaattgcgcgcacccgcgtagatcgtggtatcgcaagctacatcgttaacggcaccggcacaaatcagccgtccggtattttgttgcaaattgacgcggcaaaacgcaaatccgttgccctggcagattttacctttgaagccctggtagatgcgctgcattcagttgatccggcttaccgtagccgtccgggctttggttttgcaatgcacgatcaaacccttgccgttatgcgcaaatggaaagatgagcagggcaaccctatttatgttcgcagcctggcaaccgatcgccctgacacctttatgggctatccgctgattatcgataacgaactgccgattttggccgccggggcaaaaggcgctgttattgttggtgattttaaatcaatcctggttcgccgcgttggctccatgattattcgccgactggatgagctttacgccgaaacggatcaagttggtttcctggcatttgagcgtttcgactgcgtgctcgatgacaagcaggctatcgcggcgatcgatatcgcagcggcaggcggtggcggcggttctgctttcaaatcagcagaaaccgaacaggaaaacaaagccgacgatgacagcggcaaggacatgatcggcggcggcgctgataacgtcccagcaatggaataacaaaaaataacgtgtataataaaaggggctgacgcccctttttctttggagttaaataaatggctgataatgatgcgttttacacccttgagcaattaaaaaaacaatgccgtgtcgattggtctgatgacgatgaaatgatacagctttatggcgatacggcatttgaggctgtatcaacatatcttgataggaaaattattccagaatcgcaaacgccagttgactttactgaggttgcatataataaaaaaataaaaatggcaatatttttaattacagatgacctgtataacaatcgcggctctcaaaatgattatcaaatttatgagaatgccgcattaaaattattgctagatccaatgaagcgcctttatataggaatctcagcatgaatacgggaaaattaaaagacagaatcaagctattaaaaaagacgccagtaaaggatagcaaaggcgttacaaataaatatgactttattgtcatagatagctttcgcggaaattatcgcgggcttccaggtaaagaaattttaatggagcttgcgcaaattaatttgcgtggaggcacacttctaacaaggtattataaaaatgcaaatgaagattacatgattaaagtaaatgatggtgaaatttacgaaatcgttacctttgagcataacgacaacaaaacgtcaaccctatggacgttaaggcgagccagggtttaattatggctaaaataaatcggcaaaatactagcgaagttgatgcaacggattttttcgatgttatagataaatataaattaagcaagcttgagctaaggcaggcgcttagaccggcggcgcaatatttatttgctaaagagcaaagcgcgctaggtaaaggctgggggataagaacgggcagacttagccgggaggggcttaaaattggcgtgtctgccagggacgaaacaaacggcggcgcatatagaatttatttcagtaaaaaaagtgggccgcggggtactgatgaatatatggctgatacatataaagccaggtggctggagggaggaacaaagccgcactatacagcaaagggcgcgaccagaaaaaaaagggcgcagggcaggcttagattaaattcaagacaaagaaggttaatgcaccctggatttaaagcgcggccagtggtggaaacggtggttaagcaaaatgagcaagatgtaagaaatattgttatgaataatttattgccattgctcaagaaaaggggggcagaagatggagacgaaagttaaatttattgaaatgatgagcaggcttttagatacggataatatttattatgaaatgattccagaagataataaaatatttcccgcatttgcttatatttttgacgatcagcaatcgactagcgaaatcaagggttcgccacaaaatcagctaatccttgtatcgtttgacattgccactaaaagcgtcgatgatctagacgccatccaatgcaagctgttatcattgagcggcaaacgtaatagatggtttcagcttgttcaggttgtatcacaggctgacggtggaaccaacatagaaacacaaggcgacattgtaacggcccttgctagcattactttatactcatgaggatttattaaaatgtcagattgcaacgcaattaaaaacgcaacattgggcgcgggaaccattttccgtgttagttatgactgcggcgagacgttcgaggaagtagagggcatgaccggcgttggcgttatcggtgaaatgtctgaatcggttgaaaccacgtctatcaaagatcggacgcgcacctatattccgtcaattaaaaccccggcgtcaaaaacatttacgggaaaccatcggccagaaattgccgcccaggcaaaatttattgctgcggcagacgcaaaccagtctgtgattattcagattgatttgccgacaaatccaatcacccgcgcaactgccggttatgccctattgggccatcaaattaatgagccgacctctgacggcgctatcacctttactattaacgcccagggttcagggccgacaaaaaaagagtatatcccggttatcgccgttactggcattaccgtttccccaacaacactaaccggcgcgcctggtgaaactggtgaattgacgtttacaattaccccagccacggcgacaaataaaaaaattcagcttttcagtgaagatccggccagcgtgggaatttccgcgcacccaacagatccgcttaaagccatcgttacctatgtgcgcgataccactacgccggtaaacgttagcgcgacaaccgaagacgggttctttaaagcagttgccgccgtcacggttgacacgccttaatattaaataaaattaaatggcgggtattatcccgccttttttagctaataggaaaataaaatgacatatattaaatcactgttaaattctgcacctaaaattaaatacgttgttgtccctgttcctgaaatgggtaaaaatgcccaggtaagattaaaggaaatggacggcgaggaagttttagaatttaacgacgaatgcaacaagcatccagatgaagctatgatttattggatggctagacttattactgcctgcgccgttgatgaagatggcaacagaatccataaatatgacgaatataagctaatcgtcaaggcgcttaatcgtgacggaattcttgtaaagattttccagaaagccgccgagcttaacggcttcacgcgaaaaaatgttgacgatgcaaaaaagggttcaaggacagcgtaattaaatcccttgcgcggcggatatgcaccgatcatggattacctttttttgttgttctaaaatggcctgctagtgaatttgcgatgtgggcggctcattatgagatggaatatgaatattatgaatccatcaaaaataacaagccaggagtggtggaacttaacaaaaaagatgacgatcctaatgttactgctaacgccgttcttgctgtcctgaatgtaatgtaagggggatttatgcctataattaacacgcttttaacagcccaagataaaatgggcggcgtattggaatcagcaaagaaaaaagttaaagactccacggacggaatgaaaaaaagccttgatggcgttaatgattccgttaggagcgttgaggattcatttgatgatttatccaatatcgatttaacaagcttttctgggatcgtcgatacatttaaaaatatcagggatagagccgccgaggctgaattaggcgctagcagatgggcaactagccttgcgatgactggcgcagttattggcgcaacagctttcggcattatgacgctggttaatagcagcgctcaatatgtatcgcaattaaatgaaattcacaccgcaaccggcgttagcattgaggatttgcagcgcttgcaatcggtattttccaccactgggcttgccgttgaaaagttcggtgatttaaataaagacaccctggatcatttgggcgatgcgtttcgtgatggctcaggcccagcaaaagacatggaggcttacgggctaaaattacaggattataataaatatttaaaccaggcaaacgggggtgtacaggcgttaatccatacatattacgaattaaaaagcgctggcaggactcaggcggaaatcgtaaatatgatggaaacccttgctagtgattcctctcaccttatcagcgttctttctgaattagggacggaacaagacgcattaaacgcgctgcaaaaagttaacgtgcaactttccgacgatagcgcaaaggcttatcaggaatatgaaaaaaaggttaaatcactagacacaacatttcagctatggaaagcaaatgcattagcgccaacggtaacggaattaacaacaatccttgatttgcttaatggaaattgggattcaacaaacttttctagatgggcgaaaaacttttattatggtggtgataccgccattgcgaaaatgcttagagatctggacaatgtgccagcatctagcattcctgggacagaagcaaataacagattaaacgcctatgcggctaatgcactggcagaccaaaaggcgctaaccaacccggagccaacaggtggatgggttgaccaggataaattaaaaaaagagcaggaagcagcaaagaaaaaagcagatgccgaggcaaaaagagcggcggcagatgcaaagcgagcgcaaaaagagcaggagcaagaagctaagcggcttcaacaacaaaaggataatgcaaaaaaatgggcgcagcagcaagaattaaatataatgacggaaagtcaaaaggttgatgcgcaatatgctagcgacctggaaaaattaaaggaatatcacgacaagaaattattaagcgaggatgaatatcaaagatctcttgatgtgttgcaggcgggttattccgttaagcgcgcggaggccgacgcggaaataaatgaaagaatgactaaggcaatgtttgataaacagtctgagtcatacgaaaaacaaaatgagtttttatcaaaaggaattgatatagccggacaatttgcaacggcgatcgcatccagcgcggaaaaaggttcagcggcctggtatgtggcaaccacggcccagaaagcctttgcggtggctcaagccatcatggcggctaacctggcggcggtacaggccgcagctatgacgcctggcgacgtcgctacgcggtttgcggctggcgagtctatgagagcatggggttatgccaacgcggccattatagcggcaacaggcatcatggagattgccggagccagggcaaacggtggcgatgttgcggcgggcggaacttacctggtgggggagcgcggccctgagctgtttaccgctccaggtactggtgggcagataacatctaacgcaaatttacaaaaagccatcggggataatggaggaaaaacaatttccccaacaattaaatttgaacaacataacgttttccaaagttccggcgtcaccgctgacgatttaaataaattacagcaaaccacggaaaccatgattgacagaaaactaagaacggaaagcaggcctggagggattcttaatccataaaaagtgttgacaaattgaacattttaggccatagtttgcaatgattatggcctttttaattggtgataaaatgaataaaattagtttgaaattatttcacgcaatatttgatgcagaaaacgacgttgcaaccatgcgcgctatggggtgttatgggatggctaatgctgcaaataaattaaaggttaagaaattgcgcagatattttaaggagttttcagggaaaagcgtaaatagcctacacttgcaagcatatggcagaatgaatagaaataaggccggataaatggctgaatcattccatgtatggttaattgattttaaaagcggaaaaactttaaccatgctatctaacgaatgcccagacaaaaaggccgcgcttgaatccgcgcttgaaaggttcgggccaaaaaaggttagcggcgtaagggagaggggcgaaaagaagcaacctatcacgcctttaaagtgattcgtttgtgagttatactaaggccgctaatcagcggctttataaccaattggggctttaaaatggcagacctaaaaacattctcctggcctttgtcacctggaattcctgagaattcagcgccatctgtaaccgttctaaaatttactgatggctatgagcaaaggaaaagcaataccataaacgacgatcttaaatcctatacaggcagcataacgataaatattgacgaggctatgcgaatttctgaatttcttgaatatcatggcgcaatcaaggcttttaactggtatagcgaaacaagaaagaaaaaagttaaagttgtatgcagaaagtggactagaacggaaaataacactcatgccgttttttctttaaactttgatgaggtgatgaattaatggccgacaataatttaatgaggatagaatctgacagccttgagcaaacggcatcagtgattttattcgaagtcgatttaacccccatcggcggagacgtccatagatttcacggcgggttaaaccaacttgcgggcgctgtaaaatggcagggcattacatacgatcccttcgtaacaaatatagagggaattagttttacaaaccaagggccaagcggcagaccgattttcacggtagctaacataaccggcataatcacagggatggtgattcaatataatgaattggttggcgcaattgtttacgttagggaggtttacgcaaaattccttgatgctgataattttgtcaacgggaacgaaaacgccgatccaaaccagcaatatatttcaatgtatgaaatagaaaagcttaatcaacttgatgaagattttgcatcatttgaattatgcttgccgtcagaatctgataacgcttatatcccggttcaggttataatgtctgaaaattgtcaatttgaatatcgcggcgagggttgcagatatgccggtagcgcatattttgatgacaaagacaacccggtaacaagtatcgatcaggatagatgcggcaaacgattaaattcgtgtaagctaagattcggtgaaaataattcactaccagcaagaatttatccgtcatgctctaaggttcaatcatgatagaaaatattatattgagacatgccgaatcagagcacccaaacgagtgttgcggcatagttgttaaatgcaacaaaagtaatgaattaaaatacatgccatttaaaaacatggcaatagacaagctcaatcaattttttatagggccaatggattatatttctgcaatgtctagcggagaaataattgcaatagtccattctcaccctagcgccagccattcaagaacgctatcacatagcgatcgagttagtcagatgggcgtaaataagccttattggctggttgttgatggagtaattaaaaagtatccgccaatacttaaatttaaaaaaagaaaattcattgagggggaggtagattgctataatatattcaaagatttctatgctttttgcggcctggaaatgggagaatactcaaaggcggagggatacagaatcggcgaatggtggaaggccccaggcgctacctctccttatttggataatatggaaaaagaaggattctataaagtaaagcttggcgaaatattgcctggcgacgttatattatcttacctttgttgcccactggttaatcatgctatgatttattttggcggcaatgaaattttccaccacttgcctaatcggttatcgcttattgagcctttgcgagattatttcattaaaatgaaagatagtgtttggcgtcataaggattacaaatcccttgaaatagaaagaacaattaatttcataaggagtaaataaaatggcaattgtaaaaatgagcggctccattgctgatgaatttggctatgagtttaaaatgaacgccataaatttcagcgaatgcctgagatctatgttcgtgcaactcccagggcttcaaaaatattttactaataataatttcatcataacaatttccggtaacaaagtttccgggaatgatgatgcggaaaagatgaaacatttctttatccctcttgcaaaagatgaggttgtatacgtcacccctgcaattatgggcgctggcagtggcggcgttggggcgttccagatcgtggccggtgtggtggctgttgcggctgcgttttggactggtggcgctagcattgcggcatggtctgctgctaatatggcccttgctgctggcggtgctatgatgatattgggcggcgtcgcaacgctgatggtaaaaactccatcggcatcaatgcaaaaagacgcaattcaatcagaaaatacatcattttcatcagtcgataatatcgcaggacagggccaggttcacgcattgatttatggtgaatgtatgattggctcaatggttggatctcaatcaatagaaactctataagggcgttatatggcaattttaatttcaggaatattaaaagatggtatgtcaaaccctatggccgggtataccgttttatttatcagcaaaaaaaatacaagcgatgttttaaacacggttgtggggaaaacggttactgataatttcggcgcttattccattaacgctggcgttggcgaatatgttgtagcctattatcgtgaagggcttgaaacaaaaacggcaggctgtattaaggttttgcctgattccgtgccaggagatattaattcattcttgaccacaccaggcgaatcagaattaacgcctgaaattgttcaagccgtgatgaattatagaaatcaagcccaggcggcggcggaggcggcgattaaagccgcgaaagatgcaaagctctacgttgattccgccgtaggtctgcaaaagccatatcttgatattgacctggctaaagccgatattacaagcggcattatcaaagataagcaagttttttctgttgtatctccaacaaaaaaaaatacatatgatctttggtataataacgccggtgttgctacgccaattttaaatactgatggcgtccaggtttcatatccatcaacagcggcacttgatgaagttttaaatcttgtcaagcaaagcgagacggcaacgcattttttcgaagttgtagatgatttcgaatatatcggatttagcattagtggcgaggatggaacaataaattcaatggacaatattatattgactccaaacaagctacaaaataaaaaggtaactattgaggataaccgccttgatattggcagcaccgaaataacccagcaggattcagaatacctgatttatcttgaagatggtcgcggctatcaacttgaagtttcaacaggtgcaaataattcaggaacaaccccgccgccggaaaatgactggcagcaattaattcaaagaaatgccgaaaacattgcaaaagccaatgcaattttcagaaaaaggaatactttcactcagccatttaactgcaaatataatggcgtcataatgacaagtcaaagcctcggaactggatatgagggctggcccgccattagtaatgtgtggtatgagaatcttaataataaaatgctcggcaactcaaccaggccaagcagtagatcggcaaatgaatttattccgcttggaaattcaagcctacaaaatttaaaggccgtcactcagtcaattgatggcctgtcaattctcaacgattcacagaccagcgcgctcgcgcctggggcatcaaatgagggtgagtctcctatcgttgccgccgtgaattatttgaaatatttataccttgaggataaagggcttaaatctgacgacaacatgattttagttgccagtgataccggcgtcgcaggtcgaacgattgagcaattaattaatattttatttaaaagatttacagatgctgttgatggtcaaatggccgcagccattgcggcaggcggtgattattgcgttcccctcattttcttcatgcaaggcgaatggaactacacaacagcatacggcggcactgttgatcctactgaatataaggcgtttgttaatacatattttgacatggttacaaattatgtgatgacaaaaacgggacaggaaaagccgccagcatttgtcatttatcaaaccggtgctggctatacaaacgtggatgatttaataaaaattggcaaggctcaatttgaattaagtcaagaacgggaaggcgtagtaatggcgtcaaccgtataccaggaaacggacaagggcgggcatttgcagccgaatggctatgctaacgttggcgcaaggcttggatatgcagcatttaaatactgcattaagcgtgaaaattttgtgccaactcatattaaaaattatgtcgcaaaaggcaaggaagttttatgcaatgtcattgcatatgaatatcctataatttcaaagccagcatataacgtagtcacgcctatggattacctgtcaaaaggatttaagccagtagatagcgcaggcattaaccaggttactagcgttgaatttgtggcggattcgattataaaattaaatctgcaacgcgagattgtcggcgacttgtggattgtttacgctggtaaaaatgattataatggtaatggcaatatatgcgactcatcaagcgtgctatgcccgtataagtacgtttaccaggaggggcgcggtcagtacccagcaacaaatattcctgagctggtaggaaaaccatatgacatgtcaaactggcttgtcgctaacagaattcaagcagaggtgattaaatgaaaaaaggaacacgcgttaaatctttagggtatgatttgcgccattctgcccgcaaaagaaattggctatattccaatggttgccgctaccttaattattttaacgggcctgatggaaatttaacaagaaatcttattataggaatgccagaggcgactgtatttggctctcctgtagttggagaaaattttgttgagtttactcacggaatcgcctatttaaatactggcattttagaaaatgacgggatgacgcttttagctgctggcgtcgggccaaatcctggcgatgattcgttgatgatttcaaactacggcggtaaattgcagggatctactactgcaacaacaaccgggactagcttgatgttcagggcttccactactgcaagcgggattgtaactgttattgatgacgttagcggcgcatcatcgttaattcaatcaaactttgcatatgtgaacggcagcaatcaattccttgctatgcgctttgggccagcgcttggcggcgtggatgcctggaacatgacaaatacagcctacaaaaacaccccgctcagatcaggtaagcatgtggcgcttggcgatgcgtttttaatcggtagctcatatggatttggaaccggcaaaaaagttaaaatgtttggcgctgcgatttttgacagggttttgggcgctagcgaaatatcaacggtatatcaggccatgaaagctgatttccttcttgataatatcgctgtttaatttaaatatggcgggctagtcccgccatttaaagaggatttaattatgggtaagggcggcggcgggagccagcatacaccagtagaacaagacgacaacttaaaaacaagccaaataatatctattatagatatatggggcgaggggactattttaggtacagtaaatggattaaaagatgttttcttaaatgataccgccgttatgtccgagagtggtgaaataaacattcctggcataacctatctttggaataacgggacggaagatcaggattatttatctggatttgacggatcggcaaatataattccggttggcgttacagtaaaaaaagactctccagtagtaagaaccgtaacaaattcattagttgacaggctttctataatcctgggtacgcctgcattatatgaagtttcagataatggcgacacaaacaggacaaatttaagcctgtccgttcaggtgtttgatggtggctcatgggttgaaaaagggcgacttgattggattgataaaaaatcaagaggtgaagcactagcgcaagtgtttattgatgacctgccgccaacaccttttaatattagggttgtaagagaaacagatgattcaacatcccaaaaactggctaacgattctttttggagatcttatactgaaatagttgatgaaaaattcaggtggccgctaactgcatatgcgggaattaaaatagattctaaaagtttcgggggccaggttccaagaagaaactatcgtgtaaaagggcttgttgttcaaatccctagtaattatgatccggtaaatagaacatacgccggattctgggatggtgaatttaaagcggcatggactgataaccccgcatggatagcttacgatgttgtcactactaagcgatacggattaggccgtagagttcccgctgaattatttgataaatactttatgtataaagtaagcatgttttgtgatcaaatggttgatgatgggtttggtggtcttgagcctagaatgacatgcaatgtaaatttgacggaacgcagaccggcgcgcgatgttataaatgatttttattccatatttagaggtatgcccgtgtgggacggaatgacatattccgggtatatagacacgcctgatgatcctgtttatacctataacagatcaaacataaaaggcaagttcacctattcatcaagccaaagaaaggacaggcacaccgcgctggaagttacatttatagataaaaaaaacaacttcaaaaaagaaactatttacgttcaggacgacgatcttgtaaacagatatggattcaaccttaaaaaagttgatgcgtttggatgctctacgagaggccaggctaaaagggccgggctttatattcttgagactgaaaagctagaaaggaatatggtttcattctcagttggcgcatccgggcttttccatcttccaggaaacataattgaaattgccgactcatcttattatggcgcaagcattggcggcagggttttgtcattctcccaggataaaaaaacaataacactggatagggagatagagataccagcgggcgctgttgcgactttcggctatgtatccaatgagcgtaaagtaaaaaaaatagagatagaaagctattttgacaaaacaatcgttttgaaattaccagcaaatgatataaaagagtatgccgcatggagtcttgggataaacaattccaccactcgccttttccgctgcatggggattactagaacggattctggcgaatttggtataaatgccgttgaacatattccagaaaagacggcaattattgataatggcgttatctttgatcctccggcgaatagcctttaccccgatacaataccggcaccaacaaatatattgcttgagccgtctcctgatttgttggctgggcaatatagggcgcattgggatacgccaagaacagcaaggataattaatttccaggttaaattaatgctccttggcgctgttgtctcaagtcaaattgttgacaggccggaggtttattattctgaattgtcaattggtaattatgtgattcaggtaagaggtatagatcagaaagggaaaatgggtgcggttgctgaggctgcttttagcattgccttacctgaaacccctattgatatatcatggacgtccggcaatttaactgccacattgaagcctgtgacaaaaccaatcaggactatcggcgaggggtataaatggtattttggtaatactgaggccgaagttatcgcccagactaattatcttggcgaggcttttattttaaataaagtcgatcttagacctcagacaacttattggtttggctgtagagcgtttaacccaattgggatttccccagggattagaaccgtacagattcaaacaaaatttgactcaactgatcttgagggcttgataaaccaggcgttgccaaatacggattatataaaagaaataaataaggacatagacggattaagcgacctggcgactatgcgcgttgttgataagaacggcacaaacccacggattaccggcatctatatgaatgccggggatgcggaaagcggtgttgctagcattattgatttcgtggctgatgcgctggcaatttcaagccctgacaacctggagcgatgggtttactttgacagcgttaatagacagctagttatcgttggtgacattagggcgcgcgcaggcacgctagacaacgtcacaataaacgaaagctgcgtaatcaaaggtaagctatccgtcgctaacattgaaggttactcaatggaggggcaaagctacgaatttaccataaacaccactggcacaagaaaaacaattaactatgcaggaaacccacaaatacccgttaggctttttgggcaggtatgggccaggcagtacaagaaccaaaaaacaagggttcgtgttaacggcaccttgatagatcaactggaggtttctgtgatagttaacgacaacgggacggtaactacgcgcgcttatgtgtggctatatacatttgttaaagacctggcagtaaaccaggccgctgagattgtcatagatggcggcgctatagaccagggaaacagcgagtcaacatcataccgggcgcagttctggattgctccccagtctaacggatttagctctgattaattttttattaaaaaatgaaaaaaacacttgcgcaaggatgcgcttttgtttatctttgttcttgccgaaacaaatcgcgcaacagataattttaacttaaacaagaggcgttaaatcatgtcaaacaaaaaaccttttctgatcgtccacggtaaaactcagatcgtagttttcgctatggctctctctaccgcagaagcgcacgcaaaatctatcgcaacaaaagacctggccgccgactgcgtacacctgccgacgcctgaatatcgcaccactgatttcaccgcgatcaatcgcgtgccgggcggcaaagacgacgccgacgttttcccgttcaaactgaccatcaacggcgaatctgaagtagtgcttgcgtccagcaaaatcaacgctgaaaaagcgctggaagcgaaaatccaggaaaaagcgggctactcagtaaccgatctgccggttgacctgtacggcaaagttaaatgggaaaccgtcgaaaccctggccgagcctgagccaaccgtatcaaccggtaagcgtggccgtccggcaaaaaataaagacgccgccgcagaagatgcgcacaagcaaaccgaaatggccggtgaaaacattccaggcatggaataaatatcccgctaaataaatagccgtcaataactgaccgctgaattgaaagaagcccgattatttcgggcttttttccgtctgcaagtgttgacacgttgaatgcttttatcctataatcatcttaacgaaacggcgatgggccgatcttatagaggattttaaaatgaataagttcaaagcaatcaacctgattaaatcttcaaactaccgcaccacaaaatcaaacgcagatggatcgaaaacaattattattacagttgatggaaatgtaatttccgtaatcaacgggcctcgcttaaagggtggtgactggtttgttcacatgcaaggaaaatccgcccagaaagttaaaaatcgtcaacaggcatattccgccgttttagatgaatttattattgcaattaaaaagccttgcagaatttcgttaacatgcgtcagcgaagattgtgatggtgaaaaacgctatcacctgcgcgacctggtggacggacaaagatatgaatatattaagggtgaagtaaaatataagacaaactatcttggctataatgattgggaatataattatgactttgttacggtggcaaaaataaataacgccatcaaaagacataacgatcttgaggggttaaaatgaaatcacatgatataagcatggcttacaggaagtttgttgatgaaaattatagaattccaaacgtcctgataataaaccccaaggactatatggagctaagatatgaaagatattgcgccatgttaactttgagttttgcggataaagaggcaacattcatgggggtaaaaataagggaggattgcgattgtaaatctttcgaatttagattcgaataaagttaaggcgcttaaagcgccttttctattgccttgcatattttgtttgtatcagctaaaaggctttcatatttgaatttgcttatccttccagatccaaaccagcctaaaacaattatctgataaccccactcgatccttgataccataatttgcgcctgctttttatcttcaaatagcaatgcactattaccgattattttcacttctgataattcttcatattcctttattacccattccaccacttgcgcctgtagttcatttagctgaattatcgcagttatcattatgctgagccttatataaattataagccgcgctaaaagcgtattggagattgctatagcttttcccgccgaaaacaattctttccaacatcggcgctgttgggtggtttatggctgttgctatatagcccccaggaaacgcgatttcatgcgtccgatcgctgcttttgaaataaccggttttttgaacaaactcaagcatgtttaattttttcatttaaacacctatttgttgattattttgaaaatacattgcatgatcttttttcaaatccatttcgcctaagtattcaatatccccgaagcttttcccgctaactgccattatctcttttctttttgatgacatgaagaaagtaacaaccttacaccccgtcattaaatcgcctatgtcatcctgggattgcgttgctgcatgttttgccagtaaatggccggttgaataaacgcgccaagttcttaatttaaattgctctgaatttctaagcctgtaaattctatatacaaaaaattcataaataggcgaattattttcgcctgcctttcttgcctgcaactgatagaaagtctctttacccataggccattaggccgcgctagcggccccctcctgcgttgttactgcctgcccataacctggcgcaccttgttgaagataggctccaggacgtcaacatcgcgcccattgtatgccgctatgcgagctgctccatcctcgccgccagtgctccagatatcccacaccatgccgccgtgaatctccccctggtcatcgaccttaggcgattctacgcccaggatacggcacaagcgagaaaggctaaccagctcggatttcctatccccaagattgaaagcccttaaaacatcaaaatatctaatcgtgtcatactcgctagacattaaggcaaatttcgggaacggcacgccaaggatcatagcgcgttgagcgaggaatttaaaatcaaatccatagatattcgcgccaacaaatctaacaaccttgccgccctcgctgctcgcccaatcttgcagcttatcaaaataatcaaagaactgtttcaatatttcgaattccgaaacgtcgctattcatggccctatatttaataatcgttttctgcccggagttgataaccttgcaggccatagaaacgatctcgccgccatctgctgcgctaaatgatgttttggcgtgaagcttttcaaattcatttgctacaaaaatatccttatacccattaatccaaatctcctttaagccatcaactttcatcccttttagttgagcggcctcaagagggttatcttgtagctttaatatatcggaaataagatcatcctttgtcttgcttccaggatctacttttacgccagcggctttatattttaggtcattaataaaatcctgatcttgcgaacggattgtttcagcgtcaaacgctacatctacaaaattattatttctcattttactttcctgttgtttatcggcgattggattatagtttatttcattcagcgtgtcaacattagaatggtacatcttcccataaccaggctccgcaacgatatgttgatacgtttaaatcctctggaaatttcccatttatggcgcaaaacgaatcatcactaagaaaaccgtccgggcttattgttccttttctgtttacgcaattcatgcaggaaacatttgagcctatcatatctatcagcgccagctcattatctattccgctatttaaataaacaacgtctttaccatatatctgttttgatatatgctctttaagctgtaaaagctcttttcttaaagctatgaaatattcggcagaatgtataatcatcgcattattccaattagttttgggtatttttcagttttatcaaccttgataaactttatccccatagttctattgattaatatttgtctgcttaaaaaagcaaaacaatcatcaaccgtattgtaatggccgctatgatctccgcatatatagcgccaccagttttgagaatcctcattaagcccgatataaccaaaataaaggtttagtgagcagacttttattgccctatcgaaaaactccagcgctatatattttttaccgcttcttattttttttatattacatgttatttgtgatattttatattcaggctgtggattaaccgccgccattatttcagcggttgaagccgatgcgggatctaaatcctcaatttctcgcatcaatgatccgcaaccaaattcaagaattttatcaccagaagaatctaatataaattttcctgaatcatcctttaaatattgcgcacaatatatcattgatgccggtcgccattgctcgccgcaatgcgggcaaattataaacggcgaatctttttttatttttctttttgctggccttcctttaattgtgtcgatggcccccagcctttcagttgtatcagtaaaatcaatccaaagacaatcctttttaccctccgctgttcgcgttccacgtcctgcgccctggacataaagaacaggtgagtgagtcgatctaagccataaaatgcaatcaatatcgggaacatcaaacccggttgaaagagccagcacggaaatcaagcaccttatatgcccctttttaaaatcattaattaatctctccctttctggattgctttttgtgtcctcagtttgtcctgttactacagccgcagaaatcccaagcgaatttaatatataagaaaaatcatttgcggtcttaacatcaggtaaaaacgcaatccattttgttctatcctttgcaatatgaatcgcttcatacgctgcattttctaaatattttgctgttacggttgataattgagatacatcaaaatctcccttactcatttttacgctagacgtatctatgcgcgtgctaatagatgattgaggattcactagcggagataaaaaaccagcccttacaagctcgcctatttctgttctatgagctacgcctgaatacatagggcgcttgccatccgttataaatacgccgtcgcccctgtaatcagtggcggttaaaccaaatccgacatatttacttttctttgcaagtcctagcgcaaatgtccaatattccccggtgccatttgtgttaaccctgtggcattcatcattaacccatatatctatttcaccgatacaatcatatttttttgcaatactgccaatggtggcgcatataatatccgtatcagtatcaaatctatcaagggatgccgaataaataccaacagaaactccaggcaacatggcctttaatttttcggcgttctgggcgcatagctcctttgatggaacggtaacaaccattctaagttttttaaatgggaataactctttccccttttgccagatcctgggaacaacaacagatttccccgatcctgttggcaggactattacgggcattctcccatgatgggattgtacccatttccacgcattattaacggcatccgtttgataatatctatcctggaaaaccataagaattaaccctcaacttttgcgctgaatgtttttttaatcatgttaataccagaatcgccgacaagctccttgcctttacacccgttaatttcatatgatgaataatcgccctctatacccccattataaaatgaattcccattcaatagatttagatattttattctatttttttcaaaatccttttcctcaaccgttgcccacgttgacaaaaaatcaggattgaatctgtgatattcacatgaatgcctgttgacttgttcgtctggggataactgctttccattttgtgcgttgcaagcagaataaccatttggcccaattctataataaatacaagttctacaagttggcggcggcgtttctggtgccatgcaaacaaccccgaatgggcatgactcgcattttttatttatcccggtttccggttgagccaactgaatcggcattgattcagagctaacgcctttatttaccgtttcataaacctttctggcaaggttgaaatcaatatcaataacggtaaagtcaatatctccagtcgatgggcagtaaatgaatttaacgaatttcttaaactcagatacagccatgcataattgagcggcgttaatggtaaacgatgaaagcccatttgatttataatttttaaattgaattttgttcgctatcgatacggacattagggcgcgctcgttgttacactccggcaagccgccagaaattaccgcgtctatttcttcaaaaatatgaccataacccaatgttattaattgcggcgtatctttcataaatgacacgcccatagatcgcaagtctgatattaatcgagacgcaaaacttacgcgctcatcataaacgcgttttatcttttcgtctggatgaaatgggattgcaaaccttgatgacaaaaaagccgccctggagcactcgttatcaatggcggtaactgagtgtttaaagcagaaatccacactggcggaatattccaccatctgccctaatctttttaacgttggtttcataattaattcctatgaaataggggctttcgcccctattgttattaaagcagattttattttttagccaaagtttggcccgttccaaaccccggaatttccatttgcggcatttccattttgcccgcccggtaatgattcagaattctggttgttatttgctggctggttttgttgctccattccctgcccgccattatttgcgaagtttccgccgccgttgttgttaaagccattgttttgttgctgctgaaaattgccgttctgctgctggctgttctgctgctggccgttgttttggttaaagccctgctgttgattatcaaaccctgaattgccaggattgttttgctggccgccctgctgctggccgttattttgttgcccgccattggtgccgaaattattcattacctggccgttgttgttattgccgccagaatttgcttgctgcaatggcaagcgatcgttaacaacgttgcgcggctcggctggctcctgctgggattgttcgccgtacatatgatccgggttattacggtttttttgcggctgcaaaccaacatcagcaataaagcgctttccgacaaggcgattaggatcgcgctctttgtagcctgggccaaaaatagccaggcaaagcttagcgtaatctgcctggccgattgcctgggtttggcctggatttctttcttctggcgatgagtattgcaaattataggagtcgaaaactttacgcccgctaaattcaccgccctctacggtcaattccgttttgcaaacaaaacctgtttttttgttattttcctcatacgaggcggctgtaataacaaccggatagcggcccttaggaattgagccgcgaccagatgacggcgctacctgttcgtcaacaaacatcccgccgccctgctgctggtagccgttattttgttgctgatagccgccctgttgttgaccgccattgccattaaagccgttattaaagccgttgttttgaccgttgccgccaaaatttccgccgttaccgaagttaccgccgttaccgaagttaccgttgttattgaaattaccgttcattgcgcctttccttatatggttaagattttctgtactgcttcaacaatagttggctcatacatattaacgattttgtttctcactcggcaagtataaacgccatcgtcgcttgtttgcactattacttttgatgctacatttccgttattatcttgcacctgtacacggcgcatattaataacatgattcatcaatccagtaaactgaattgcgtattttgccccctcgcacatcgcaccgtatttaccatcctttagcaagacctcatgcgcattcatataaacatgcattgggaatcgccgtatatcgtcaattaagcggcggaaatcaatatatccgcgcgcataatccaatcgcctatctggtgaattctcccccgttgctttcaagcacatataagaaagattagttgcaccgtcaaggcaaattaaatcatatggccttaaatctatctggccttttcttattgcgcctatagctaagtaaagatcggcgattttgtcaatttcaataaagggaatattaaattcccctaaggttgacatgccgccaggatcgcaggcgataacgaaagggttaaagcctgcgtgttgcaatctggcgatcgataacgttttttcagtgttaggcaaaccataagccaaaaggtctaactttatgttttgcctgttgtttgttgttttaatctgcaaactcattttgtggttgctccgcgtttcgatagtgggtatgatggccccatatgttcagcgtgtcaacagggaatcataaaaaaatgattagccaaaaattagacgaattgattaaacaatgtggcgggctgtctgggtttgcgcgtgaactgcaagggcaaggatttgaaaaaatcagccataccgctatacgcaattggtacgagagcaaatcaacccatccgttgaaaaaataccatgatgcaattaaggcagtcgcaaaaaatcgcggctttgaaatcacggatgatgaggcgtttcctaaagcatgagcaacaaagcgaaagcgatagaatacgccaaagtaggattaaaattaatccccttatggtggataaacagcgaaggtgtttgcgcctgcggcgatgccttatgcataggaacaaaccagggcaaacatccgatagccagcctggttaaaaccgcattaaaggaggcaaccagcgatttagaaaagatagaaaagtggtggactaaatacccaaacgcaaatattggcatggcctgccgagcgtcggggctttttgtcgttgacgtcgatctccatgacgaaaataaaaacggtttcgaatcccttgatgattgggaaaccacatttgacgacaaaataaaatcaaaagttagccaggacactggcggcggcgggcagcatatatttttcaggatgccagaagggctatcaactgccccatctggaatgggcaaaaactatcctggagtagattttaaattcaatggctacgtattactatcgccgtcaaaccacaagagcgggaataaatacgagtggagcgatgataagagcgaagaaaatttattaagtggtaaagttccaccacttcctcgctccatcgttaagtttatatccgatggtcaagatgggaaaaataaatcacctgaaagatattcagccccagccagggttcaagatgatgacgatgtaaaccagatgcgcgatgcgcttaactgcatgtcgttttttggcatggacgacgatgagcgattaaaagtcgggatgggattgcaacaagttttgcctggcggcgtcggcaagtcgctttatttcgattggctatctcaaaaccttggaagtaagtttaatataaagctttcagaaaggcgctggagatcatttaaatttagacctggcggcaggacgatagcaagtttctatgaagtcgcggccaggttcggctttattaatgaaggtaagcgcgggacatttataaaccccgatgattatgtttacatggagcctacattagtaaaaaaagcatatgtagaaagtagcaatatatttgattcgatgtttgttattgaggatgccgggccatcaatgacagtcgatcaggacgcggagccgccagttatggcggttgatatgtatgcgcaggcatcgccggattatagagatccatcaaatcctaattttacttttgagcctgcggaatttaaaggtgattcatgtatgaatgaattatttaatgctgtaaataaaatagctactgaggaaaaggattttaacaaaggaatgccaacgcccgcacaatgggatgaatggaaatccaggttaagcaacaataaaacgctgttttcaatttttaaatatcaagttgagaacaacagttcttttgttcctgagctggctttaggttttacgttatccgtttttggcggtctaatgtctgggcgctttaaggttgatgacgttacaacaaatctttatgtacttatcgttgcaccatcaagcataggcaagtcacaaaccatcggcatgatgagtaaaatattttcattcactggcgatcataacagatttggccctaaagatattgtttctgataaaggattctataatgatttaattatagatcgcgccaggatgtttccgcttgatgagataggcgagctttttggaacaattttcggcccgcgtgccaacccgtcacaagctgcaattaaaagggccatccttgatggattcagcgcattctctatcgagctaaataaaacagcgtcaaaggcgagcgccaaggattcgccagtggtaaaccttggaagaatttcaccgtcaatctttggcgtaacaactcccgcgaaaatctggcaagcatttagcggcagggatattgttgacggctttcttaacaggatgtttcttttaaattcagaggcaatacacccgatcggtaagttgtcgatgaaaacggaattgccaagggagtttatcgactggttttatgccataagatcaaggtggcagcaaaacggaattatgccagtatcaaattctgatacttgcaccgaattaaaaatagcgccagatgcaaaaatttatctggacgcgataaaggacattgaaacaagaaataaaaatgcaagtgaaaaatatgggttaatctgggggcgattaacagaaataacaattaggattgcaattatattcgagttaaccgaaaggccattttcgagccaggtaaacaaagacagcatccaggcggcgtttcagcttgtccactggtcactgtcaaatactgacaaggtggcaagaacaaaaattgctgattcagaggaagaatcaataatgaaggaagtttatgagaaggtggttaattcacctaggggaattttctatagcgagcttaccgaatcaaccaggcttgccggaaatctgcgacttagagcgcaaatcctttccgctttgaaggatgagcaaaaaataaaagaatactcatttgctaaaaaaggccagcgcgggcgacctaagaaactttacttaacgcctgaaaactatatgaatttaccgcatgaaataaaagagcaactaaaggatctggctctagaaatttaaccgcctccgggcggtttttctttgcctgcaagtgttgacacgttgaatgttttttagtatatttaatctcaagcaacagatgttgccataacaggagaggtgattaaaatgaaaaaatttacaacacgcgacgaaagcaccggtaaagtaactaaggaacacaaagaacttagcacgctggaagctgcattgatggttgacgctagcgtttctgaggcgctaatcattcaggatatgatcgttggcgcaaaagttttctttagcggcctttcggtagaaagaacagcataaattaaatagcccggttcgccgggcttttctggagaattttttatgaaaattaaatttaatttaagcccttgggctattgtgtttttggtttctggcgttttctggtctgcaatcgcagcggcaattatctttaaaatggtgcaatcataatgattattcgtgttgatttcgccgatttcatggctgctataacaataaaaggcgctaacgagccacggcaggagcttaattgcgtcctgttcgaacggttttctggcgatgttggtaacgttatttcatcaaatggcgttgttttgtttgtcggaaagtgtgaaatcccacaaattccaggaagcaaagacagcattttgttgtcattttcaggtaagccgccgtctaaatttgattatgctgaggtgcgaactaatgaaaaccttgtctatttcatgcaaaaatcgccaaaaaatggcgcaattagtaaagctggcgttgcgatttgcagcatttctaacgctatttttcctgattggcgcaagcttttagcaaaaagatgcagtaaattaggcggaatcaagcttaattccgcgcatttttcaaaggtgatgcagtgcgccaagcgatttaatcgtgataaatcattttcaatttcgttttccggtagtggcatattcgccaaaatagatgttagctttgaatcatgtttttacattcgcggtatggagggttaaaaaatgcttatgaccagatacgaaaaaggcgtagcactggcagcgatcgccaaagttatgatgattaatgccgttgatttggatacagcaatgcatttcatttatgacaatcagcggagattgtttatgatgaatgaaggggttgatgtcctcagggctgaaaagctgttaaaggttagcgcagaaaaattaatttctgatgaaactgcggattatgcctacgaagccaggccggttcgtgaaatggttgaggaattcaacttgaagcgatgcccatcaataaccataaatgaatcagatccacacactgattcggaaggtgtttttaaataaattattaaaactcgcaccagaaattaattccaccacttgctcttaattagccatctttaaatataaaggtggcttttttatgcgtgtaacttgctggaaactataggatttgttggttattgtttagtaattaaccatgttaaatcatgtaaacacccctccccctcccaatatttttctaaactaatggggagggggagtctggttggtgcttgtcttaccctccccctatgaaatttattcatcttgatagggggtctaatcgtcatttatcgtgattaaaatccatgtgctcaaaaaataatcgaatcgtccgaggccagacggggcaagggttgtagtcttttatttatatatatttatttatttatttatattactacctaccccttacgctctaggctcccctccccctccaggttgactcactagggggagggggtgtatagtttcatctgtataggggttcgtaatccagaaaatgatttaaataacccattaaatctaagttcttgttttataagtagattgttatctaattaacctttaatttacataagtatatgattacaaaggagatattgcatgacgcgtaaagaagccgtagcggccctgatgccggttgttgaactgttgctgagtatggataagcggctggccgctctggagcgctccgggcctgctggcgggtctgaggcgtcgcctttgtggtctggtcagtacccggccagggttacagaaatcaacgacaccccagataaatacgtttttaaattaaatattcaggataaggattttgcattttcaatgctgcgaagcgaatttgtaaaaaaattctttacatcacttaccgcctcagaggcggaaatcaaaccagaaattaaactcgcatggcctgggatttttgatgatgacacgctaagcaaagaaaaattaatgcaaatcgttttatctgcaaaaattgtgaagcgcggcggtcatcctgaggcgatcgaggaagtgaccgacattaacccgatgttagggtaagtggtggaaaaatgagaagaataggatcatcaacaatagaaaggcacactgttactttttattccggtaaaaatgctgttggcgcttattgcgtaattgctaaatgcactacgcgcgataataaaagattatcggcaacaggaaaaagcgttagccaggctatcgactttttggtttcagaaattcaccgccacgaaaaaatgagggctgcgaaatgagggtttctctacgcgaacaaatgccatacggtagcgaagaattttatggagcatcagagcaaaagcaccaacaggctgttatggaattcgttaggcaggaattgccaagggaattgagcttagatatttttgcaattcccaacggcggcagcaggaacaaattagaggcgcaaaacatgaaagccgagggcgttttgtctggcgtcctggatttattttgttctgttccaggcggaaattatcacggcttatttattgaaatgaaaaaaccaaaaggcggggaaataagtttaaatcaaattgattttattaatcgcaagcgatcattaaattaccttgcctttgtttgcgttgattggtttcaggcggttaatttattaaagtggtatctctccggttatttaaatttagtgaccgataataataaataccaggaatacgaaacaattagcctgggttctttatgcgcctgcggccttgacctgaaagcgcaactagaaggcgtct

SEQ ID NO: 10 - DNA, 51560 bp, Unknown
  bacteriophage genomic DNA
ccactttgtagatcgggttttccgatccgtcctctttcgccgggccgtagctgtcaacaacggttgtttcttcccatttatcgtaacagataaaagcataatcaaacggttttaatccgtgactttccataatctccattgcgcgctgaaccgttaaaccgcagtgctcgcggacgtcgttcatgtcggcttgctccttccatgtccaaaaaccgatctccttcgcaatttccttcgccgcttcggtttcagtatcgctcatggttcgaacatcatttttcaaccgtgcatcggaggtgttgatagttccgtttacggcgtaaatgttcattgcccggccagatccccaacctaagttgtatctgttatccgccatcggcattaacgttccgttatggtcaaccccccatcgcggcattcgagtaatactttcagattcgcacgtctcgaaaacaacctgtgttggagttgaagttttaccccagcccgcatttgccttgattgtcacgctaccacgcattgagtcgaacttctcgccatcatgaccagacgcaccgagatagaaagtcgaaccgttttgtacagcgccaatatatctcgtttcatcggacagactgccatcgcaccacatggcgcgaatcgctggcgacgatgtgttagagccacgcggcgcgatcatgttaatttctggcgttggagaaccaacaagtttcaacccgcgaccatcctggttagttggtgcattaaaggcaggaacgactgcgttcaacgtctcaaagctacgcacaagcccaagatccgggtgcatggctccgtccggaataagccaaagatctccgttatctgacagcctgaatgccggaaccctatcgctaatcgtcttacctttaggggtgacaagcaagcgaatccagccgccgtgattggttccagatgtatcgccagcgccaaggaaatgcaaggccgcgttactgtgctccgtgtagtcagaacctaaccacgggcgagagccataaccacctaaaagctggttgttcttcgttacgctattggaagcccctcgcgcatagttatggaatacagcagatccgccagccgtattctcaatcccgaaagagcattccgttgcgttgttgccgataaagttaacgccaaccccggttgttgcggtcgtttccttcagcggtaagccctgcgacgcggtaacatccactccgtcacgaaggttagatgcaccattgacgcggagcgtgcttaacatcgtaaccgcatttctgaaagtggcattcaacccggtaacggtgaagtttgccgcatcaaaaacaacctgcttcgcgctgttcatatcgccattcgggcggaagtacatgccttgaccgccttccgggatggagtaaacgatcgcgttgttgttattggcccgaactacggcaccgttcagggttagcgtagcgttaccaccagggacggagatcgcttgcggctggctgaacgtgttagctacgttggttctggcaaccgtattatcattagatgccaggtaatcagcgggtgaattgtatacaatccccgctggctccgttgtaatccacgtatagccagtgcgatcgatgattggccctgtaatcaatccgttgttggcctggacgttcaaacggtttaaccacataacgggaaagtaaccgttaggcgatagcaaataaacatcaaaagatccgtcagtgtttttcacaacccccaacttcaaacgtgacgtgctatttgatgccggaatgagtgcgcattgagtaaagtttgcgtcaatattattactggttagcgtatcaggaagaccccggccagaaatagaaaagatatcgatcgggagattcgccgaaccgaagttagcgccgccaccaataataaattgcgcaaaacagtttgactgtccagcgttcttaacgttggcaatcttcatccacgcccgcgagctacctggcgaggttggcagcttatccggcgcttgaacgccagccacaagatcgacagtctggttataaagatcttgagtctgatcccttgccgacccggcttgttgtcgcgctgttagcgccgcttgctccgatgccttagagttagtttctgaagttttcgccgccccttctgacgcagccgccgccgacgcgctcgcgtccgccgcttcggaatctgccctcacctgatcggcaagactttgcagagcttcgaaatcgaagttcttaaagaagtcgacagcatccgcaatttcagtttcttgcgactggtagtagcgcagagtttccgcaacatcttgcgccaagccgtcaacggtcagcgagtcgcttaaaaggatcgcgtaatcgctggacgggacaaccgcgccgtttgtggtgatggcgttaatttgcgtatcactgacaaccttgttaatcaccgccatttgaatcggcgacgataaaaacatgattgttgagcctgggcgaatgagcgataaggctgattgccacttcgtgccagtcccggtgataacgccgtttgcgtccatcgcggctttgccttgtctgtatagtgccattttaagacctcttttggttggttgagtaacgcagataatagcatcaatgaagcaataaaaaaaggagccttgcggcccctttagttgtcaaatcagaacgggatatcatcatcgaaatccatgccctgattaccaccaccgctttgcggcttcggttgttgttgttgcggcttcggttgctgaggctggccccatccgccctgctgattaccgccgccctgagttggttcgcgctggctgaattccagttgcggcataatcatttcattgtggctgtaagtcgccccgttgtgctcgcggtttacgatctgaagtgtccggcaggttacgctaataaccttgtccacctgcaacgcttcatcgtaccacgcaatcatgctttccttcgcgaagaagacggcgcgatagttggtgtatacagtttcgtcctggccgtcgcgattgcggatcttcattcgctccgacaggtcgacagcgtacatcttccacggcccgttattgttgctgccctcttttacgtaaggcgcttttcggattacccctgttacaacatgcattgtttttcctatggggcggtttcccgcccggttaaattagttgaaagatgagatatcttgtgcttcaggttcaggctttgattctacctgttccggctcacgtttcgcaacctcttgcggcttgcctgggttaaatccgttcgctggcgtcacttttagttgcgcctggcgcttcgtgatatcgtcttccgtcaccttccattccgcaggcgtcaacgtctgtttagccagcttgtaaatctcgcggagagattcgaggtcttcgcaagcatcaatgcgttttttgaagtcttgcggcttcatcttcgcgatctctgcgtcatcgtcggcctgcttgatgcccagcgcggcggctaacgcataacggcgagcgtatgaggttgtcgagccatatgcttgctcaacggttttgctgatcggcatgttgaactgaaacgccatccactcgccagattcgtgcaggaacatcgtttcaaggtgcataaccttgtcggtgctggtatccatcattgattgaataaccataattttgttcttttccagcgatggcccgatggcgtcaaggatatctccgagattggcgtaggtgttccccaggtggctattcttcccgcttttcttcgcggcgacgaatccagacttcgctttgattaacgcaactgcgatctctttgaaactttcagatgtacgcatgacaaactttccttttcctgattggtggagcgcactatatcacaagtgcgccgtagtgtttagctatttgtgccgtatacttccgggaacatgtatttcacgaattgcggcgtgggcaacttcacttccgctgcgttcgattcgtatgacggccaaacgtcatgcttgacgcattcggcgtactggtgaatcacgctttgatactgcttccgcccgatctcaatctgctgatccgttaacgtgaacgcgagaggcgcgaacggtgattttttctcctgagtcagcaggcggacaaccaccgggcgtttttcgttgtacgtcttaacgaacagatcgcgctgcaatgccattttgagatagtagcccaggttgaacgccagccgcccgaagtcatccggtttagaggtctgagtagttttgtagtcggtaatcaccaccacttcgaaaacttcatccgggttaaacccccactctttgatgagttcgggatctgacacgacgtcaacatgatcgagccgaacctttaccggaacgccgaaaatttcgccgaagattgacaactcgcgttgcgctgtatccgattcaatgcacgccgcgtgccgtgggttagccagcatcacgtttcgcatttgcacgaccgcatcgaaatcagaatccttgaccagcttccggcctgagttgatggcggcgctttcgtcgcagagttcgatcgcccaccacacgttaacatcaatccctgcgcggtatgccatttccagcaattcggggtagtccttgttggacgtcccaatcaggccacacgctttcaatttcgcagacaatgccgactttgaagtaatcagatccttaacgtcgcccggcgcggttgcccgcaggtactcgccattaaatttggacgtctccagcatgcaggtatgggagcaagtaccgaaggaaagcgcggctgtttcctcacgctccttgtacttccagtgggccggggaggttgcgtaaatctcgccgaggcttgagccgctaacgtatctggcgcaccaggagttaggatcgtggtaatcgtcgttggataattccgcgttggtgtatgccttaaaaattgcttcagccattggtatcactccgtttgtggtttcgttgcgttaagtatacgcatcacgattccaggtgcaaggcaaaaagtgctattcgccaaccggtcaaaaaatgagctaaatttacgtaagatttagtaagatgcatcttacgtgattttctttatatatttcatgtgtttaacccaaatcggtaagatggtaagatgcctataggtaaatattcaaagaaaaattggagcggaatcgcaaagcaaaatacatatacccggagaaaatcttacctacacagatagatagagagagagtaataataataatatagttagatatcatatacttatgtatattctatggtgcggtgttggttaaaaaatgagcgaaatttacgtaagattcatcttacctaatcttacttaaagtggtcgaccagttggtaagttgctgaattttgggcataaaaaaaggtaagactgaaattatcaatcttacctaaaatttgttcacgttttaatcagagaagggatgatgccacgtagagctttcgttcgaatccgcctttgaagttgtcattgttcggcacgataactttcatatcgcgttcttcagccgccgccagcatatcccgatctttcctgctgcatacgactcgcaattctcgcttaccttcgccgccacccttccctttatatcggtaggccacgatctcaacgttggacgggatgatgcatgcccacacgtcacacttaaacgagcttgcgatattgaagtgcatcgcctccacccaagagcgagccaggtaaattggcccgttaccgccttcgctctgattggttacgatcaccgatccgaaagtcaggtcgccagctaacatcttctcgcggccctcctcatcaatgaataagatgttgcagtattcatcgtccggcccgtcttcatgtaccagttgcatcgggagtgcatgaaatagctcttgcctgccgttctcgtgggtttttacgccaacccggtatgattcaacgaactcattttcaatgccctcatagagcgttacaggtgtgctatcgacggcctccgttctgttcattatcgccacgacgcgatcgtgatctgccatcttgccgtagtcgtacccgttatcgcgagtaacctgtttgttgcgcttaactacgtactcttgcggaactttgcccaggtatcgcccaagaatgttaatgcactcgctatacggctcgccgctcaacttcattaaccatccgatccccttatcggcaccgcagccgctgcaatacgccccgccgtcgccgcgattctctaatttgtccgtccagcggaagcgatccttaccgccgcagttagggcagtcctggtgtttgccgttgaaatagcgggagtggatgccgcaaatattttgtagcgcctcgcgccacatccccggcatgtatggcaaaacctctttttcgtcgtaaaaatccacgtcataacctccaaataaaaaacgcccacgcgagaatcataacccggtaggcgtttagtagttagtcaaattgtgctatcggactacgcggagcatttcgcgtcggtcgcagcggcgcgtaatcggcttgccgttgctgtcgaatctgagatccgggcggcaaaatgaagccctgaagcctttgcagtcattacggcggtaactcttatgaaccaggtaagcaccatcggctgaaatcatgccgcgcttaatccactgctgaacaacctggatgctaacgcccaactcctttgcggttttggcgataccgccgtatgcctcgatcaccaattccattctggtagtcaggcccgcccttacttcatccttcaggacataatagcctgtcggcttcttgcggggcttcttatctttcccgcgtgacgtcccgttattgccgttcaaagttcgcttgtctacctttgccatttgttccataatttaacctcacagcactttttgttaaacacgataaaatttgctctgtattatacacgcaaccatgcgaatgacaaatcaggattaaccatgctgacaattgaacaacaaattgaagcctacgcagacaagatcccatctattcaaaagcggttcacggtcggagatatcgtaccgtacccttaccaggctgtcgcgtacatcgagacggcgaagcggatcgcgaactatgagcatccgttctacattaaggcgtccgtatccgcaggcaagacaatcatgatcgccatgctcgcggcgcagtgcaaaacaatgaacttgcctatgatggttctcgcccggcaggctgagatcgtgaagcaggattccgaagaaatcagcaaccttgacgtgccaaactccgtttattgcgccgggttaggcacaaaggcggcttacttcccgatcgtagtcggctccgaagggacggtggtcaatggcctgtttaagatgctgggcgattacgtgccttcagtcctggcaatcgacgaatgccatcaggttgactggcaagacctcgcagaagcgatcgcgaacgatgaatccttcgagtacatgagccgcgcaaaggataagccgtatcgcgtgaatggtgagatcgtcgatgcagattacccgtacaacgaaaaattcgaaacggttgaatttggcggcgggcgtactcaatacaccatcgtaatcatagagttaatgcgccgttgccttcagaagacggggcgagaacttcgcatcgttggctacactggttcggagtttcgcggagtcattccgatcttacaggaagacaagagccagccgggtttctggcgcgagcagatcacggacattaacacaaactaccttgtcgaattcggttcggtggttccgacaatctttggtgacactgaggccgacggcttaggctacgacctgtcagagtttcacggctccagtcaggacggcacgcaggattttagcgctgaagacttgcgcaagatggagaagaaaatccacgattccggcgaaatgactaagctgattatgcagaaggtggtcgagcgtgcgcagacgcgaaacggcgtgcttatcacttgcgcgggccagcgccactgtaaggaagcggcgagctacttaccgccggacgccacatacgcgatcatcacggagaagaccaactcgaagaaacgcggtgaaattctggacaaggcgaaccggggcgagattaagtacatcttccaggtgatggccctaacgactggcgttaacgttccgttttgggatttttctgtaatccttcgcaagattggttctcttacgttgctgattcagcttttggggcgtggaatgcgattgctaaaagactggcagaaggaagcgccctattcgtgggtgaaagaagatcaccttgtctgggattttgccggaacaatggatgacctgggccagttgtatttcgatccgattttggagcaggcgcagtatcagaagcgcaagagcagcaagaacggcccgaaaatttgcccggtctgcaaaggcgaaaatagcgagtacgcccgccgctgcatccacaaggatagtaacggcaatcggtgcgagtatttttggacgtcccagcgctgcgaagaccaaaaggatccgaggacggggaaaatcaaggtcaagggatgccacgctgaaaacgacattgtggcgcgccagtgcagatgttgtggcgtgcagttaaaggatcctaacgacaacctcaccgggaagcattacacgcaaaatgactggtatcaggttgtaggctttgacctgggattgacacgaaaccaaagcgggatcatctttaattacgtgttgctcaaccatgacggcgagcggttcacggccagggaaaaattcttccctgagtcagagagcgcgatttgcggtaagttgtggcgacaaaaggcagtcttccagcatgttgatgatgctgtaatgcgtggcaagttgggcggcatgaaaaacgcccgcaagatcctggagtatgcggaatacttccgcgcgccgaagcgcgtaacgcatcgcatcaacggcaagaaggaggacattatttcccgcaaagactttggaggcgaggagtgattacagacaaaggggattacctcgaatattacggcgggcctgtaaaggcttgcccacttgaaaaaatcgaccagatgaacagcgtttcgtggctgcgttacgaataccccgattatctgttctggcatacggtcaacgagggcagcaagcacaaggcgagcgccgttgctgatcatcaaatgggattgctcaaaggcgtaagcgatatccttgtgctgattgggatgggcggcaaatacccgttcgccgccattgagctaaagcgccagggtaaatcccaggcatcgccagtaagcaaggagcaacgtgaattcctcgccgccgtccgaagccgtggcgggttcgctgccgtggcctatggattcgagcagtttaagatcgcgtttgaagacgcaatcaaatagcactttttgttaaaactacccggcgcgagtcgggtaatattctctcatcgaaacgaacaagagggtttaaaaatgaaaaaatttgctttctaccttttttctgtagcttgcggtgtggttgctacaggatttgggttatgggttatctcgctcgctggacactttaaggggttctaaatgaaagatatcgcagacaaagacactcacgacgcgttcacgacgtttgaacagcttgaacgtgaaacgttcataggaaacgcgcttgccactggcggacactatcaggccgtcaagcctgataaattctaccaggtaacgggcaaccgctacgccgggagcaaaacgccggatatcgtccgcgacaagtggtcaaccgatcgcagccttattgcttacatggaggagcgttacgggccatacgacctggacgccgccgccgaagaaagcaacaccgtctgcccgaagttttacgacgaaaagaccgattgcctcaagcgctggtgggggaaaaataagcacgtatggcttaacccgccttactcgttcccggatccctttgtgctgaaagccattgagcagatggagcatgacaaccagatcgatattttgcttcccggcgacaactctactgcgtggttccgcgacgcacagaaggcagcggctgagattatttggattgtcgcagacgtcacagaggacgaagacggaacgcaactaagccgatccggtcgcctggccttcatcaacggcctaagcgggaaaccagtcgacaacaacaacaagggcagcgtgattttcatcatgcgcaaactcaagcctggcgaggagcaaaaaaacgttctacgtcccggtaagcgaaatctgcccttcattaactaaaaagcgcatgcgcaaacgtgggatctgaaaaatggaacagcttgaatctttcaccgaatacctacacatcgtcgttaccctgctggacaagtacggcttcatcggtacggatgaagaaaagatggccttcgccgatagcatcgacggcacttatcaagagttcatggataacggcacgccgcttgctgactggcccgcgattcttgagcgcgaattgctggattttcgggcgcgtgaaggtgcggaatatttcgcgaaacagcactaattgctaaacaatgcccgccgcgagcgggtattattgttccatcaaccaatcaggagctaacgccatgaacaccaaaaccattgccgacaccatcaagatcgcacaagttaagccgcacatcgtatcgcgccacctgattaacctttctcgcctgtgcatggccgactacgtggcgaagcctttagagaatggccttgatggtgaaatcggcgcaatctacttccgcgcagcccacggcatcgaagaaattcacatgtatgagcagatggcggaatgcttctgcatttatggtgacgaataatgattgtagaatctggccgcgctgccgtttggcagcatgccaaagaggctggcattagtgacgatatcgtgatgatcgcaaagtatttcgatatcaaggatatctccattgtgttcaatgggaaatttacctatcttcatgagcgcccactgaagcgcacgcgtatagcagttgcgacgcgggcggaggccgacgctctgaagatgttcattaatgagtcgaagcagaccaaaaaatattacaagtagcgggagtgttgagaatgcgatatattgcgatcctgattacggcggtggttctcactatcgcaatctttaactacgcaattcaattgggataaattatgcaacctaaaatcacagacgaagaatttttagccgcccgcgaggaaggcaagacctaccgcgagatcgccgaagagttcggcatgaacgttcgcagtgtggagcgtcgcggcgttcgacttgcccgccaggggcatttgcacggtaacaaccacgtagcaaaacacatcccggacgggttcggggtcaaaggcacatcgaccatgattcgcgcgaacggtgacgaagttgtgcgctgggtcaagtcagaagtagaccgcgaccgcatgatcgctttgatggaggcggcgcaagcatcattctgcgaagacctcccgcgcgctgaaccgcagccgaaggatgaatcgaagtttttcattgaggatcagcttgctctgtatccgatcttcgacttgcacatcggcgcgatggcccacaagcacgaatgcggcgagaactacgacaccagcacagccgaaagggttcttaaccgcttctttgactattccgtttcggttgccccgcagtcgaaaaaggcggtcttgctggtcggcggtgacttccttcacagtgacggcctggacgcagtaaccccggcaagtggtcacgttctcgatcaggatagccgttacgcgaaacttgtctatgtggctattcgctccttgcgccgcgccgtgtcgctattgctgagtaatcacgcggaagtagaggtgcaggtaatcgaggggaaccacgatcaggctggcatgatctggttgcgtgcagcactcgcagcgttctatgaaaatgagccgcgcgtattcgttgacgtcagccctgcgattctgcatcgcaccgtatggggcaaaacgatgctgggctacactcacggccacacgatgaagaaggcagaaacgcgcctcgccgcaatggctactgacttccgcaaggagttcgggcaatgcgactacatctacacgcattcgggccattggcatcaccagaccgtcacggagcactcgttagggattgacgaagtacacggccagttaggggccaaagacgcttacgccgctcgcggtggttggcgctcctatcgccaggcggcggttattctgtacagcaaagaatatggcgaagtaggccgttttatctaccgcccgaacatgtaaccacaacggccccgcgaggggccaacaaggaaaaccgatgaatagaaatatctgcattttcgatctcgatggcacgttgtccaatggcaaccaccgtttgcacctgctgccgaaaaaagatctccacctaaccgaaagctggacggcgttcaacatggcggctggcggcgacgctcccattacggacacgatccgggtaatggaggccatgcgcgcagcaggatttatcgtcatcatcctgaccgggcgaagtgatgaggcacgcgagatcactgaaaaatggctggtgcaaaatggcgcatcgcattacgacctgctgattatgcgctccgcctccgacaaccggaaagatacggttatcaaagaggaaattttacgcaagattggcattgagcgaatcgttgcggcgtgggatgatagccccactgttattgcgcacttccgtagccttggtatcacaacttaccaggtctgcgactacggcgaaaaccttcacgatcatctgaaatctcatggagtagacaaatgaaaaatgtaatcatcctcaacggcgcaccgggcatcggaaaagacaccatcgcggaaatcatcgcccgcaaatgggagtatcggatcctgagtttcaaatcaccgatgtttgacattgcgcgcgccatcctgggtgcaaccgactttgcccgcttcgccgtccgttaccacgaccgcagccggaaagaagtcaagtgcgactttttaggagaccgctcgccgcgtgaattcctgattcacattagcgaaaatttcgtaaagccgacgttaggcaaaaagcagttcggcaagttgctttgcgattccgtcgtgaattcgcctgttagttgcgtcgtcagcgacggcggatttgacgaagaagtagagcacatcgcggcgcacgatagcgtaaacgtctttgtcgttcgcctgcatcgtgacggcatgactttcgagggtgatagccgcaagcatattagccgaccggatctggtttgcgaaacttatcacgaattcgattttgatatgacgactggcgagccggaagacgacgcacaaaaaatccttgatatggtttttgaagggtattaatattatctaagtaatgcctttattatcaccaccttaaactttgggagccttaacaggctcccttttttttgttctttatttggcccaacgcatatatcatcgcattatcacttaactaacagaggttgcatatcatgcgggaattcatcaacgcggcaaccaatggtagcggcggtgttaccctcgcaggctctgcgaccgggcaacttatcattgcggccattggtttatttttcatgattctattcggctccttcggcgcgtggttgcgctggcgagattcaaaggcgcttcgtgaagcgctggaagccggggatatcaaaacggcggtgaagatcaggagtaaataacatggggattaaaacgcgggttacattcgcggcggcgatggcgatcgctgtcgccttcctcccgaaagtggaggacacgaaatacaaagtttataccgatatcgctggcgtttcgacggtctgcgaaggcatcacagggccggacgtaatcaaagggaaaacctatacccggtcagagtgcgatgatcttttggcgaagcacatccaggtcgcaaagcgtgtagttgacagcaaaatcaaagtggccgtgccggacaccttcagggcgtcgatgtacagcttcactttcaacgctggcggcggtgcatactccggcagcactatgctgaagttgacgaaccaggggcggctatatgaggcgtgcgaacagctttaccgctggacgtactatcgcaacccgaaaacgggcaagatggaaaaatcgcgcggcctgcataatcgccgggatcaggaattcaatctgtgcattaaggatctaaaatgagtagcttaaattttcagcgagcattggcaatcggcttcatcgtgtgggcggttgcactggtttccggttgcgcttccagcgtcccgatcctttccgatctggtgggcagtaagccggatatgacggcgcaagtaggagcggagaacgtgaaacaggcggttggcgtgacgaacaaaacggacacgtccagcaagcaggaaacgaccttcaaagaatcggcagttggcaaggttgacacgtccaacaaaaaggcggtgacgacctccagcattcacgcgaaccagattacggcggagaagatcgagatccgaaacgacgatagcggaagcatgattccgtggctgattggtgccgttggggtcatcatgttcgctgtcggtgttttcggtatgtggcgagagcgaaaaaataaaggggcgtaagccccttttttcatatgtaccgtttgacgtgcagaagtgccacaccatcttcatcattcaacccatgttcaaccgtgtttgtcgcggccatgccttgatatagcaatgtgagcgcggcacgcaagtaattttctggtgtgatctgattcacgcaaacaagcctgtgaacctccgttatcagatcttccacctgctttcccgaatagggcttcatcgtcgagttgctcaatgtgcatcatctcccacatgtatttgttgtccatcccttcaaacgaccggaagttaaatccaatctccctgttatcagggccagtacaccacaccacgccgttttttccgtccaggtatccattcgtatagcttcgcgctaaaaactccttagaaaccattgaggcgaacatacggtgtgacacgttggcggcttttgccatgcgcggcgattcgcggtgcatgtaaacgaacttcgcaaaatcttgccgggtaaattccaggcgagactcgcagaatcggtaaatgtcaaggataaacattcattacctcatgaacgaagggttaataaagacctctgaatcaatcacgcagatgaaccctaattcctccatcttcggcagcaatttttccttaatccttttgcttaccccggactgacctttgaagatcttcagattgcggcacgcgttatagatgctctgaaccgtcatcacgcctttagcctgcttgccacggctggcgataacatcgtacaccgccttaatctccgcgccctcaccagcgaagccggacgaatcagccgacgacaaatacgttttgctcaactcatgaaacatgatgatggcttcgtcgatcgtttcggttccgatcttcttcgagcgcttgccgccaggttgccagttgcggatcgtgtggattaccgacgccaggcgcatcacctgcttatcgaatttacccatcgcaccgcgcagcatcgtatgcgaatacttcccgccgtcgcctaattccggctccaactcctggcgggccttgttcagccgacgcatacctgcttcagtcacttccagcttgatatacgattccgtcataatatcatgaatgaggcggaagtaatcagcgcgtaaagacttgtcgatcggctcataggtcgaattcccgttttcgtcaatgaacacacgctcacctaaccgcgtttgctcgcgaaccaaaaggaaacgctctgatacaccgataccgcgagaaccagcttgcatgatggcgtcgatggtttcatcctgggcgattacgcaaatacagcccagcgcgacgaatgacatattgttactgacgtcggaacgtgcgatcgatacgtggcccttatcccacgccttcaacaccagttcgctgttcgtcttcttgccgccgtcgtttccatacgtgatccctaacaggctgttaaccgctgtcgcttcgtccgagataaccgcaaagttgccttgccgattgttgattttcgccaggccttccggcgtggtatcggaaacggggaacgtcagatcgcacatgctttctaacttctcctcaagttcgtctttgtcttcgaacagtttcgccatatctgactgcgataactcgcctttcatggcctgcttgttggcggacaacttcgccatgattttcttgcgctctttcttgcgcgcctcgttgattcgctcaacctctgcgacgatcggatcgatagccagcgagttaatcgcagacttaccagcggaaggcggctgcgacgtaatgacgtaaagcgtcgttggttgctcgctgccgtggtactccacccaaaagcgacccatcatcgcggcggacacggttccgaggaaatgcatataagccgatgattccgggaattgaacggatcgagcggcgttgagcgccagcttgccgacgatatcgtaatcattcgcgatcgagatcgtggggtacttgtccgcgtttacgtcgatatctttcggcttgggccagaaagaaacggagtcgcgatacccgttcgcacggatggcgacgcgcaaggggctgatgccttccttctctgcgatggcaataatatcttgtggtgacacgcggtcatttaaaaacatgccttgctcctgattggttaatcgtgcggctaatgataagccgtcttaaatacgagatccagtgataatctaaactcacttgcaaaatgtgcttaggttatcggggcgcatggccccgaatccgttacaggtatttcgcctcaaacgtggtgccgtccgacacgctgaaaccgacttcctcacggtagagcgtccagcggcaaccgtcacggtcgaagatgtacccggcgacgccgcccagcgctcgaccactttccacctggtaacgcttgccgacggtgaaggattttttcaccgggtttttgtggtcgaggccaacgcatttcagggttttcgttttcagttcgataaacgtcgccaccaccacgccgccaacgccagcaatgaacaactcaccgctaatgccgaccgacaagtaaacgcgcttcttcagttcggcgctgttatataccatcattgacacattgccttcgtcgtcaatgcgagcggaataaaggttgttttcctggatattaacagcacggcttgaggtgcatttaattttgattgactttgccattttatttcctttctcccatttcgatatagaggtttaccagatccagaaagtcggatttgtttctgcaactcaatttaaagccaacgtgcgattcgatcttattttgcattgccgccatcgttgcgccgccgttattcatcttcagaacttcgcggcatacgtcagcaagttttttagatatcatatttcaccaccgtaaatttagtgtttttgcaagcgccttcgatatcgctaattaggcgattcactctgatattaatcatcgttttgtggtgcatgacgtcaacaatcccacaaacccacaagatcatgattgaaaagataagagcaccaggcccatgcatagaaaatagtgcggtcattactgcgatcgtgaatttcattctggttttctccgttgcgtttcgatggaataactatacccgcaattaagcgggtacgtttagcaattcgtgctattcattaaagttcgcctggaacacggcgcgagcgaatccgcgaggagtgatagagcgaagcatctttgttctttcagacttaccgccaaggaatttccacgcccaaaagaaatcgacgccttccacaccttccggcggtaataaacgtttcggctccacgaatccgttaccgtgccagatgcacgttttcttcgtgtaattgtcgcagtgcggcatttttgggtgccaaacttcctcatgcggcgcaacatacccgccgaagtcgcgagggtggaaataaaaatccggcttgcgccaaagcgtcgacaattttccaaccgggttttctaccatccaggggcaattatattggtcgcccaattgctcgatcatcttcgcatcatcggcggctgatagaacatcctgagtcttccgggcgtgcttcaccccgctatgcgctaacagcgtgcaggaagggaaagcgaaaataatgtcaggatccgggatgcccaggatcgtgcgcttcacgtcgaaatctttgtcaatccagatgttgacatactggatttttgcatgctccatgcggattttgtactcgccgtggtcgccggaatctgcgttaaagcaatatacatcgcaaccgcgaattgcccacggcagacccataatcccggaaccgtcaaacatgcaccacacaacgcgctttttcattgtcacctcaccagaaagggatacattcgcggcaaccttcttcaccagtacagccgcaactattttcttcttgctctaccagatcgtcacgcatcggcagactttcgtcatccatatccatacttcccagggcatccgatagcgtcatttcctgattggctactttgatgcaatattcgcggttaagccccgcatcctgggcggttaagaaacggtgccagtaggcatcgtcgtaattatcagccattgcttttcctccggttaaattctcgcaaactggcggcgcatgacttcgaacaggttttaccccagccgcgtttaagatccgccgccttgaccttatagacagccccgcatcctggagcctcgcagcacttcatgctttccttcgccccaatgtgatccggtcgaccagtcagggagctatcgccgggattcttcgtcgaccagaaaagttgcactgtcgcgacctcctcgccaaactcattgacgaacatgtagacgcccttgcttttcagaagcacggtgcaatgatgcatttcgccgttgacttccaggtatgcgcgatcgccttctttcattagcttctccacgattcaatgaacatgctgttcgattccagcgtcagcgtgacgccagccagggaggacggaatcaggcgagcgcccggaaccgttccgacaacatagcgaccattcgatttggtaatcgtgatctgagtaaagccggattcgcggttcatgcggagaacaacgcgaccgtgtgcatgcaggacggccaggatcgaatcagtctttggatggttcattgtgtaactccttcgtttgttggtgtggggacagtatgccaccatccccaaattctgttttagcaattcgtgctattcgggaacgcaggtcgtgtaatcctggcagatgtagattgtgcgctgaacacgcggcgcggcatcctccaggctctgaacctcgatatcgttgctgtcgacccggcagggtgttgcaccgaagatgaaataccccgtctgcttgtcgttgatttgccacgccttgctttcgggaaccgtattgacgacaaacggcgtgtcgtcggctttgaagtcttcagggtgacgcccgtaatagtggatgattgcagcagttgccgccgccttaaacttttccgtcacgtctcgggcagcgatatcacgcgagatctggatatcaacatccggcgcgccgaccatgtaggtaaagctgttcgaaatggtaactgttctcatttagatcttaacctcgtttcggtggatgaagtcggcgacatagtggcactcgatcgggttttcgatcccggagagaacctcacagcgcccgttgttcagtaactggcaatgctggcaatcagatccgccaacattagctatgacgatggcgatcccgttgcatgaaccgccgaacatccgatgagggaaggggtaagcctcgcaggtgcaaaccacctccccagccctccgctttctcatgcgctccccttctcgatgcagaagacccaatcgcgagcatcaaccgcgaagcgtgccacgccgtcgagcacgatgaaaacggtctgcccgttaacgccgcgacccttctcaatatcggtgacggtgcggaacaggtcgcttgcgccatattgaattttgtccccgattacgacgtcgccaaatgctttcatggttgctctcctgattggtttcgatgtggtaatgataccaggcctcgcggcccggcgtttagcaattcgtgcttatttgatgccctgtgcaattttatccattttgcggaaccaaatagccagttcttcaagcatatcgaacaggtcagcttttttgctttccatgatggcatcacagatcagattgatatcgcaagccatgactccgaggtattcaccgtaagcgcgtacacctgcaatgttagaagacttgctatcacggcggcatttctgcgctttgtaaatcaggctcatgattttggaagtttctttggtcaggatatgtacgttgctcatgatgtttgcctctttgtctgcttcgtttcgatgaatagacaatagcaaaagcccacgaggggcttttaacaaaaagtgctatttacaccaggcggaaccgaacttcatcaccgtaaatcacggcctgaatgtgatcgccaaatgtgatggttgcgcgagtggtttcgtactccgtgtggccgtatcgccatatcccgcgctggggataatgcgccgcgctttcgtgccaaatgttcatagtgaactctccagactccccgaactccaggcactggccgaccatcgctttgacggcctggtagtcatgccagcgttgagtagcacgatctgtaacgcgctccacacgattgcgctctttgtgctccgccgcagcctcaaccacggcccacttactacgggtaaagattctcattgctggaactcctttttgatttgggcgcggaaccgcgaagcatctttttctgcccgttcagcgctgtgatatcgtttcagaaacagggtatcaatccccatgcaaagcgtttcgtcggcgctgtatttccccacaagccaaagactgaccgtctgcctgtccaggccgtagttcttatcgaagtgaacgcgcacattaacagggacatagccatgcgtcgaaatgaaggcatcaacgcgatcgaatagctcttgcttgttcatgattattcctcaacggtgaatttaatcggctccttcccggtcgccttgcgatgggagttgaccagcgtttcgaacttgccgatgcactcgcgcaaatcagtgaacgtgctggcgctccccatgacacgccatgattcgacgttctgcccgcgaacatagttgatgacgtgcttcatgattttgtactggtcgccatcttttttggtgtacacgtgcagcactgcgatcctggttgatttgtaggcgaatgctttggtgatgtatttgcaagtttgcatcgtgttcgctcctgactggttgatgtgatgactatacctgatccggccagcagggttttgattatttgtgctattcctgcgattgtctattattccaccgattcggaatagtggaataggctgtgattgcacctgattacctggtgattacttttgacgattcatgattgattgtgattgtttcattctgtgcaatgagatgatggagtgtttcatgatgtgcaacgaattgcatagatgcatgcaccgtgcacataattcgccgttcgaatcctgccaaaacggttgccagttcacagtaaccgaatgcagttcacgcgcagttcagtaagataatcttacgtaaaagttgatcaaaaagtgcgcagcataagcatataaatatacatataagtatatgataaacttaatattattattattattattctattattctctctatctgaatattccagttcacgtaagatagtaaggatatgtgctaccattttcgcttgcgacagcctccaaaaaattcagtgttccgcgccgccagggtatataggagggtaggggtatatcttactttcttacgcaaactgacttgacgccttgccacgcctggcttagtatgcttactgaattggaacgtaagtggagagaattacagtgaacaagagcgaaactgaacaaaaatgggagtttgagcaggtcgatcccgaagtgtggatggcctatccgccagataaacaggccgcttatcatgcctggctcgcgggcgatatcttcggcgatgatgacgaaccggagtcggagcgcgagcggaaacaggtcggtggcaagcgggaggggccaaccatccaaagcctgattgaacaggattttattgatggcggtctgtccggcaaggtcgacgtcgaggcgttcagcgccacgcatggcaagcagataacatcgcacgctatcaggtcggcactgaagcatcacatcggcaaacatggcaagttcagaaccaggacgcgcgacggcgtgatcgaatactggatcgaacgcgatgaatcggcgattagcagcgatgagcaaatccaggcagaccgggaacgggttatcggaatcattcacgcgctgaccggagaggatcttgatgtgcgtatcgagccaatcacggcccgcgtgcttatccaggctatcaagctgaacgtcaaagcaggagatatcaaatgaacagcgccagggttatcagcaaagccgcaagggcggagcaaaagagagcaattgcgatcgtggaaagcacaatccctaatcatccgctgtatagaaagtgcaaagcggagttaatcgccagaatcaaaggggaaaaggtatgaaactctatcaagaccagtccgacccggcggcaccaatgcgcctgggaagcgagccagtaagcgagcaggacgttatcgacgcagtaatcaatgcatcacaggcagaaaatcccagcgccttagaatgcgttacagatgacttgcttttgatggcatttcttccagattctgagtcatacatccagcacattaccgaaacgggccaggcagtaacgcgaccggagttcgtcggagcgcctaacgtgcttcagatgatgcttgacagcgccgacaatatcgttagcctggactatccacaatgagcgccttcatcctgttttccatcggtgttaattgcggattgctcctggcggcatttatcatccacctgagcaacaagtagcactttttgcaaaaacccggtcagagggatcgggtattatcaccacatcaccaacgagaggagcatcaaccatgccacgctttaacagaacgcttcaactccgcaccttcgccgggcttcagatcccgaaggattcgacgaaggcagtgccgggccgcgaattcggcgtgtacttccactggcagggcaaatggcgctttaccgtcattcgcggcttttacgtgacctgcgacggcgttgacattgacgaccacagcggcgggaaccaggttcacaacttcaaatagcactttttgttaaaacacgatcggggtggcttgctatagttatcccatcgaaacgaacaacggagcaccacaatgaaatctcgcgaatacctcaacactcttaatggcctgatttactggctggaagatgacgcagtgatgatgcgcaagcgcgaaggcaagattgtgaagaagtcgaatatgacagcggcgatcttctttgcgatggtcggcaacgatacacttctgcttgtcgagtcggagccagagcaaaagagcatgaccatgaacgaattctctaacttcctggctggcatcgacaaaagcaccacgactgcaaccgcacagacgaccatccagggcggggccacccacattgccatcgacggtaacggcgacgtcttcgcattcaagatgcgcccgcgccactgcctgccggatgacgacgacgcgaatgattacctgggcgaatggcttcgcggttcggagcagtacggacacattgcgcgaacagtctgcttcctgggtaacactggccgcgagcatcgcaactggcgggaactctgtttccagatcccacagcaatagcactttttgttaaaacgcaattggggtgatgcgctatcattaccccatcgaaacagaggagcataaaaatgatcggcaaccataacaacccactcaatgcagcatttcaccgtcgcgcggtagagcaacacttccacgcgctgaaggtggtgtgcaacgagatgaatcttatgcttgacctgccgtcatgggatgctcaactggaagattactatgatggcctgcgcgctaaacgggatggcatcattacccgcctgcgcctggctggaatgtttctataggagaaaacaacatgcaacaattcgaatctcgcggcaagacctacaacctgccggacactgcaacccacgccgcacctggtgcatgcgtcggcgtttactttaaggatggcgatagctggtttttcatgggtgatgtgattggggatgtaccgccgaagaaatgcggcgtgctcctgggcttctacgatcacgacgtggttgagttgaagccaaagcgcgtaccgttcgccttctggaataaaatcaaaggggcgctgttcaaatgagcgaccctaaactgcaaacggtatgctaccgcgattcggatggcgatgaattggtcgtgtcgccgttcagtggtggcgctgctggcgtagagcttatggcgacccacgatagcggttgctgcgtatttgacgaccctaaggtaatccgcgatctggctaatcagttgctgttcgtcgccgatgccgtagagagcgcacaaggagcagaaaaatgaaccagttcgaatatatgcatcgcgcacataaagcgcttgccatgttcgcctttcacctggatatgaaagttatatccgtgaccattgaggccggaagcattgagatctgcggattcgtgggcgattactcatgcaccagaacttacgcgttctcctcgctcgcttccctggagaatcaggcttatggcttctaacagcaagttcaggatcgtgcgcattgcgacgcttgacgccttcgggcgtccggtggagtggtatgcagcacagcggcgtgttgccttcttctggtgggtgacggtcgaacacttcggccagttgacgcaggcccgctactggctccacaaatccggcgcaccgcaccgaccggaacgggtaatcaaggtggttgaatagcacgaattgctaaaactcgatcggggtaggctggtatagttaccccataccaacaagcgaggctaacaccatgaaattacgttgcaccgattccaacactatcaactacacccctggctttgagtacagcgcggagctgggcgttaccgtccgcacccctcatggctcgatcggctgtgatgtggttcatggtaacaacacctggttctttttcaacaaatcaaccctcaacgccgaacgccgtaacggttcggtcgtggcaacctttaaggtaatcgaataatgaccaacgaaatcaaatccggcggcaagattgttgccaccattgcgcagcgccaggttgtggcgtttcagattaacatccacagcaccagcgatgcaaaagccgtcgacgtgccagtgtgggccaatacgattgccgttgacgaagacggcgcgatttgggcttatgagtcagtcgccgaagatgttcgcattatcggcgtaaacaaagcctgggtagactgcgggcgctgcgatgcgaaaatgcaggaaatcggagagatggagccattcgctgactggaaagaatcgcaaatcgaccttcgcaccatgcaatagcactttttggtaaacgcccggtcaacggatcgggcataattatcccacaccaacaacggagatttaccatgaaacactttatcaaaaacgcagtcgtcgccatcgtcggcaccaactttgagggcaagaaggcccgcattcacctgctgcatgtgggcaatgacggcaaaatgcgtggggcgctctactacggcgaacgcggcgaggtcttgtacgattctaaattcctctcccgccttgtccgcttccagcctgaaaaggagttcatggagtggtcgccggaatatctctgcgaagggctggtggtcgaatcgttcgttgccgatccggttaagctgacctcgcgcgactataagcgcatggcccgtaaggcgcataaactcatgaagcgcacgccgaaaaaccacgcgtggcacatcttcgccaaccaactgtgagatctgacgcgatggaaaccgtaacagtaatttgcactcatgctggctacgggccactggctccgctgttcaccgtgggcaaggagtatcaagccaggttcggccctggccttgatgaagtgtggattttgcaggacgaccagggaaccactgaggacgaagaattttggcccgcctgccgtatgccggacgaaaagatcgccatgtacgccaataggccatacgaaaacaacgttttatttgaggtgaaagtatgaaagtaagcaaaaagaaactagcgctgtattgggccttcttcctggttggcctggccctgcatgacagcgtgggctggcagacgatcggaatgctgtgcatgattattggtgtatgccgactgtctgagattaacgggttccgccggggatatcgggcagcgttcagcggcgaaaaagaatagcactttttgttaaaactgccgtaacgtcatttgataaagtggcgttactgaagtgaacaatccaatcaggagcaacgcaatgaacgataatttaatcgcactgctggaagaactgaattcctacggctgcgcatacatcgagctttcgagcgagcaggttattgaagtcgcaatcgacgatgacgccgggtttaccagattaagggtggcggcaggagccgaagaggaattcgaagactgcggcatccgtgaagtaaccaatcttctcgaatcccaccaggtgaaggagatccgctaatgaaaaccgtcaagctaatggttgtcaatgcagcccgcgaacgtgaacgccacattatcggctgcgtattcgatgccgtcgaggtcaaagactcaaaaggagactttcacgtaatacaaggcggatatcttaacgaatttatcgtcaatccgctggatactgacgaagatttaaccatccgtgttggtgatgagccggaaaacgcgcttttccacctgcggaaagtatcgaaggcgtcgcagcgcaagttgctggttcgcgcactgaagcgcattgcgaagcagcgcggctacaccgatgcatacatacgcaagttcggcacgttcgctggcgtaggcgattgggcgcggtcatgggccgacttttacttcaacaaatcaggagaattctgttccacccatacggactggctgcatggcacagaacacgatcccgttaacggccacgagtggtacgaattcattgaggcggaattagacgccctttgatagcacgaattgctaaaacgaacgtccggggatggtgcatactatccccacacaaacaagcgaaggagcttaacaatgaacaccacacaaatcattcacctgatcccgtccgacaacttcgccaaagacgacgccgacccgctgttagcagccgtcattcgtgccgggatcgattgggcgcttagcgatgcatcgtgcgaatcattcatgcgtgagccgttctcacgaatcgcggagcttgaacagcaggttgcgttcctgactggtgaacttcaggaggctatcgccacgatcgagaaggttcgggaaatcatgcgtaccgaacctggctatgacattgaagatcacgcgcgtgttttgcgcattatggccgacgcattcgccaaactacagcaatagaaagaaccacaaacacgaatcggggttgctacatggcgaccccacaaaagacaaggaaaaacatcatgatttactcaattattgccctggtggttcttgttctgtccctgtatgcgtgcggctgtttactcatgcgggccttcctgaaatcggcggattctaccgacaaagaagatctttatcctgtgctttgctggccctggattacactttccgccgttggtagcgtgatcatttcccgcaattttaagtggtgagatggcacttggttgccaaagtggatagccagcaaaatagcacgaattgctaaaaccgatcatgggtaagctggtatagttaccccatcgaaacgaaacggagttacagcaatgaaaatcaaaatcaccaaagtagacactcttaacggcgacggctcaattaccctggaagaatgcggcctcaaaatcggagaagttcttgaggtcgacggacacttcaacgacggctcctactgtgtgatcgctccgcgcaatagcgagtttatccaggctggtgacaatatcagcgtaagcgcagacgaatgcgaggttgtggaagaatgagcaacaaaatttgggtactgacttacaccattggaaccaacgaagggcgcaaatcgcgccgcctcatctgcgacaccaaagagcaggcgattaggcagcaaaccgttcttggtggcgaacttgtcgagtatctccgcaagcctgaagcgttcaaggtgaactggccggaaggcatggatatcaacggcgctttagcgagcctgcgtgagatgcagcacaacccgaagacgtggagcgactttcaatgcctgcgggcggagccggaagtgaaggccgacccgttcaccaatattcgggcgcagcacgcggagtggtcggatcgccagtttggagacgttgggccagtcgggccgctcaaacacctggcgaaagaggcgatcgaggccgccgaagcgccggatgacattagcgagttcgccgatatcctcatgttggtatgggacgcaacgcgccgcgccggattcagcgatgagcagttggctgaagaggtggcggaaaagctggaacggaataagcgccgggcgtggggcgaggtcaaagatggcgaaccttgccaccacgtaaaaaattaacgaaatcgaataccgtttaaagcgcctgtaagccattctggcgggcgcaaatttaaggagtacgattgtatgcctgaatactcaaaagtcgaagatatgccgattggcgcaacgattactggtatccgcatgagcgagtcggacgacgccatcaagccgctggcgtttccggttacgcaggtggagacggacagcagaaaagggttcatcttcatctacaaaaatttcaatagtccgctgcgggttgaagtgttcattgctcgcggaacctgggtggaatgggagagggccaaatgttcggactgaatgaagcgcagtacaacgccgtgaagcgcgtagcgaaacgaatgacggcggaaaccaaagacgccatactgaaggacaaaaagacttacgatcaggttgccgcccggatgatcgataagcattgggccgaagtcaacacgctgttaactcgcggtcagtttatctggctggctggctatctcgaaggccgtttcggtcgccgtgatggcgagtatgagtaaaaaataagcgaacgaatcaaccgcctattgacgcattcgcgctgaccgggtatcgttaaaagcgtagacacaagaggcggtaaacatccgcaagtctcgccccgctttggggcttttattggggggttatgatgcagtacaaggtcatactcacagcaaggaaaatgggcggcttttgcaagtcctgcattcaagagttcagcatgaagattgaagcgaacgataccgccgacgcggtggagaaagcaaaaaaacaatccggcgtaaacctggatactcacaaaataagcatcaactacgtaagggaagtgaaacaatgataactctgattatcgcgttaattatgctggtcataggcttctacgccggaacattccaccttgtcgaacagctgtccaaacgcgtgcatgaaggcactttcgccgcgatgctgtacaacaagaaaacgaaacgctgggaaaaaattggcgatccgggcggtatcgcgaaacgaatagagttttcgccgctcccgtatgttgactgtgagccttttgcatcacttcagaaaacactgaagcggcgtaacaaactgatatgaacataacccgcttcggcgggtttttttgtgcctgcaatctggtatactcgcaactcaacacagaaggaggattaacaatgtctgaagaacgcaaaaaacgcgtaacgaaatcgcacttcgaaggcaatttcaaggcgctgtacgaaaaagattttggcgtagtgctggggcgaaccgccgaaatgacgccgcaacaattcttcgagatcgcgaagggttatttccagtgggccgaagaaaacgccatcaaggctgcggaaaccgccactttccagggcgacgttaacgaatggggcgtgaacaagccgcgcattttcacgatcacggggttaagcctgttttgcggcgtgaaccagtcaacgcttgtacgctatcgccacgacccgaactatgccccggtcatggagtttatcgactctgtaatctatgagcagaaattccagcttgctgccgtcggcatgattaacgcttcgttcgtcggtaaggaaatggggatcgataagcccgctgttctcaacattgacgccgtagctggcaacaagaacgagatcaccgatgaagtattggagaaggctgttagtaacattctggacaagatttaagggctgatcatgaatgacgaaatgattatttgggaagacctgaagccagccgataagctggcaatcaaggcattgagcacgcgcaacttttcgctattcctgaagatctggtttcagattatccagggcgaaaagctgatgtggaactggcatcactcctacttttgccacacggtagatgaaatcatcgccgggaagcgcaaaagcacgatcgtaaacgttgcgcctggttcgacgaaaaccgaagcgttttctatccacctcgcgccgtatgcgtatctaaagtgccggaaggttcgcaaccttcagatctcgcagggtgacgcgctttcaaaaggcaactccgaccgcgtaatcaagatcttttcatcgggcgaatggcaggagctatggccctcgaaattcgggcggaagcagatcgacgaattccaggttttggatgacaacgatcgcgtaaggctggaaatggtgtcccgttcgtctggtggtcagatcgtcggtaagcgtggcgggtacatgacgccgggttttagcggcctaatcgcgctggatgatatcgacaagcctgatgatatgttctcaaaggtgaagcgcgaaaagagccacatcttgctgaagaacaccattcgatcccgtcgtgcgaagaagaaacaaggcgacgaaacgccgatcctgtccgtacagcagcggctgcatgcacaggattccacctggttcatgatgagcggcgggatggctatcgaattcgatcgcattgttattccggctatggtaacgagggaatacggcgaatcgctccctgactggttgcgtcctgagttcgaacgcgacgtgttatccgggccgtcggtggtcattgatggtgtcgaatactggtcattttgggaggacaacgaatcgatcgagaacctggttgccttgcgcgatgccgatctttatacgttcctttcgcagtatcagcaggagccaatcgcattgggcggcaacgtgtttaagtcggaatggtggcgctattacggcgacagcgaaaaggcgcatgaaccgcgcccggataagttcgaatacaccttcattacggcggatacggcgcagaagacgaacgaactaaacgactattccgtgctgtgctattggggtaagtaccgcgatcgcgtctacttcattgatggaatccgtggcaagtgggaagcgccggatttgcgcgtgcaggctgaggcattcattaagcagtgctggcgcagaaacaaggaatgcgggaatctgcgaaagatttacatcgaagacaaggcgagcggtacaggtctaatccaggatctgaccaaagcagttaatggcatgggtgagatcgtcccggttcagcgcgacaaagataaggttactcgcgcgatggatgcgcagccaattatcaagggtggccgcgtcgtactgccggacagccatccgttcattgcggagcttgtggcggaaatgagcgcatttacctatgacgattcacatccccacgatgacatttgcgacaacgtatttgacgccgcgaacctggagatgaacctgagcgacgacccggtagagcgaatgaaacgattggcaggattgaaaaagctgggccgctaatacataatgtgggcttaacggcccacaaatcacacaaggttaaaatatgaaagctatcaagatggatgattacaatcagatcttcaatggtggagcgggatacgcgtcaaccacggcgatgattgcaagcacgttcgggaatatgtcgcaaatcgaggagttctatcacagcaacggactggcgaaaaagattgttgacgtgatcccggaagaaatggtttcgcccggcttccagcttaacggcgtctccgataatacgaaattccagtcagagtgggacggccttaaacttgagccgcaaatcaccgatgcactctgctgggcgcgcctgtatggtggctcttacgtcctggcgatggttaacgatggccgcatgctgacttcagccgcgaagcgcggtaagccactggaatcaattgtcgtttacgactacgattccgtgtccgtagcggaggaggagaaaaacccgagaagcccacgattcggcaagcctaaaatgtacaccgtcaagccgctaaacggcggtagcgactttaacgtgcattatacccgcatgcactacatcgacggcgagcgcgtaaccaacaaggtgcggaaactcaacaagggcgctggcggcacggtgctgaataagtcgatgattgaagcgattcttgattacgattattcggagtacctcgcaacgcagttgctgaagcgtaagcagcagggtgtatggaaggccaaaggtcttgctctaatctgcgacgacagggagggcgaatacgcggcccgtttgcgcatggcgcaggttgacgcgaattccggcgttggtaacacgatcggcattgatgcggacgacgaagaatacaccgtgattaactctgatatttcaggcatcccggaattcttgtccgccaaaatggatcggattgtcgcgctgtcaggcattcatgagatcgtgctgaagaacaaaaacacaggtggcgttagtgccagccaaaacactgcgttgcagacgttttataagctggtggagcgcaagcgcaacgacgactacaaaccactgttagaattcctgctacaattcattgtcactgaggaagacttcagcgtagagttcgaaccgctgtcactgcctaccgattcagagaaggctgatatctttaagaaaaacgccgaagcagtgcaggggctagtaacggatcaggttattgatgcgaacgaagcgcgtgataccctgtccgcgatggttcccgaactgaaactgaagggcaatgcgccggaacagaagcagctaccggatcgcacgtcagggtcaggaaagaccaaaacgcaaagcacgcagatcctgaacaacaccgaggagggcggcgatgaaagttaacggcagaattccaaactggcgttatcctgaagcaagcgagcgggatttatcccgcttgatgcaggacgcgacaaccgatctggtcgtggaaatgcgggatcggttagaccgcctgaagttcgacgccacggcggaggaaatcaacgaggcggaagacgatatcaacgaggcggcgatcgcgttctttgctgccgtcattgcggcgcttgcctccattggcctgaccatctaccgcttcaactctaagcagtggctggttattgcgctggcggctggtgggcgcgataatgaagcggttatgatgctgaaggaattcggcgctggtggttatgagcagtggtatcagcaggcgctgaagaaatggcaggacaccgcaaaggcatcaatccagaagttaacagccgatatcgtcgctgactggacaacgaaagttagaaccgccaacaacatcggcaagactcgcgaacagatcgatgaaatcatcgagggccgatacgccatttatggcagttggtcgcgcaaccgggcgagcggcattatcggaagttttaacagtatgttgatgatgcagcgactaaaagatgctaaagtatcgcattacttttggttcggcatgatggacgaccgcgaacgcgaaagccacatcaaactagaaggtaagcgacgccgcgtaaacggtgacggcatttttcccggcgaggagtacggttgccgttgctgggcggttcccgattttaataacgtagaggaattacaatgaaaagagttcaaagattcgacacggtaaaggtgaaggcccgctttgatgaaaacggctttctggtcgataccccgatcgttgcgcgtatcggcgcacagacctaccagaccccgaacggcccgcgcgttgagtttcgcccgcgttccgaggtgttcgacgctgaatcgctggcgtcataccagggcaagccaattactttgggtcacaagatggtcaacgccaaaaacgcgaaagggctggtagtcggatcctgttccggcgctggcaaagaggacgggatcggggttctggttccggtgatgatttacgacggggagtcgatcgagcaggcgaaacagcgcgtagcggctgaattgtccgttgggtacacctcgatcgatatcgacaaaaaaggctggggcaataacgcgacgggcgaatactacttcgatgaagacctaccggaaaacttcgaagaactgaaaaacgattccgtctctgattgggttcgctttgatgccgtgcaaacgaagattcgcgttaaccatgtggcgcttgtttttcgcgggcgcgcaggaattgcgaaattaaatcttgatagtgagcaagaatttccatatgatgacgactcaaaccacaaaggagctaaaacgatgattatcaaaattgacggcgtagacgtcgaagtagccgataacgtaggcgcacatattgctaaactggacgcacagatcgcaaccgcaaccagtcaggtaacgagcatcaccgcagagcgcgacgcacttcaaaccaaagttgatggcattgaagatgaagtggcggcgcgtgttgccaaaatcaaagccgacgaagacgcgaagcagaaagttgtcgcgatcgtatccgccgctggcatcaagtgcgacggcctggacgttaaagcgatgaaagttgcttacatcaaagaagcggatggccgcgacttgtcagataaagaagattcgtatatcgacgcttcttttgactttatctccaattctgataagatggcaagcaatcgctctaaagtcttcgccaaaaaagaagatggtgagcaggaagacaagaaaggcgcgccgaaactcgatggttctaacatcatcgacccgcaagccaaattccgtaactaataccgtgcggccttcgggccgctactaaatccaaatcaaggagatttaatcatggcaattcctgcaacctatacccgcaagcgcgatatttgcattccgggccagatcgcggatacttcgctgtacaacatcgacggcacctgtgccgctgcaaatgacattttaactggcgttctggtcgcgttgtccggtggcgttgttgatggtcataaagtggtcgataccgctaaaactgctgatgctgttctggtgggcgtaaccactcattcccattaccaatcgccggaattcaaatacgacaaattttccgccgtaaacgttatgacgcatggccgagtgtggtgtcgcgctgcatctaccgtaaccgcagccgattgtgcttttaagtcgctggtaactttcggtgatgatggcaccgtggcaaaaggcgatgctggcctaatcaaaaccgggtacactcacactggcgagtggttcaaaaacaaagatggcgtagtcctggtgaaaatccagttaacgcaggacgcaaccgcgccagccgctcccgccgctggtggcgagtaaaaaataggggcttcggcccctttttcatacgttaaaaaaacctttgaccgtttagcgattcgtgctattcttcatctcgttaagtcaaaacacacaaacaggagtttcaaatgactatgaaattagatgcattcgagcagaatgcaatcaaggttgcaatgcagggtatgggcatcgacgctaacaaactcgatgcgcacggcatctggactgttaatcagcttacccaactcttaaatcgtcagtacgagcaggcttacccgcaaactggtgtgctggagcttttcccggttactaccgaactgagtccggtaacgaaaaactttgaatggctggagtttgacggcgtgacctctgcgaaaatcatcgcggattataccgacgacctgccgaccgttgaagcgatggcgtccgagaaaactggtaaagtgttccgcctgggtaacgcgtggtttatctccatcgacgaaatcaaagcaggtcaggcgctgggttccagtctgagcgaccgcaaagcgtctcttgcacgcgaaggccatgaaaccctggtcaacgatctggtgttcaaaggttccgcgccgcataacatcgttagcgtgttcgatcagccgaacattaaccgcctgacctccgcaagctggactacgccggaaatcgcattcagcgagttgcaggatctgatcgagacgatcgaagatgtaacgctgggccgtcaccatgttaccaacatcgtgatcccaccgtccaagcgccgcctgctgacgcagaaaatgccggacgttacggaaagttacctcgcgtggttcaaagagaactacccgaatgtcaccatcaccgcgattgcggaactggaagatatcgacggcgcaggtactaaaggcgtgctggcatacgaaaaagatccgatgaatatgtcgatcgagatcccggaacgcttcaacatgctgccgatgcagccgaaagacctgcatttcaaagtgccttgcacctccaaatgcactggcctcatcgtgtatcgtccgctgaccatcgccattctttctggcgtgtaattagaatggcccttcggggccattttttattgttgcgaaaaacctttcattgtgtttaaatcaaacctcaccaaaacaggagagatacaaaatggctaaaaaagatactgctaccatcgaaccggaaatcaacgaaaagccggaaacctcacagctggaaaccgcgaagccggatatggtaacaatggaaaacgtgggcgcttgcctgattaagttcgacggcaagaaagtgctaccaggcgaaaccttcgagatcgaggagtctcaagttgaccgcttccgccacgatatcttcaaaggccgcgtagaattccacgatgatattcgccgcactcgcgactacatcgcagcagtgaaagcgaaagcaaaaaccatcgtgcagcctacgagcgccgaataaaaaaaccaataagggcgctgcggcgtcctttttcatatctggagaaagaccatgaattatacgattcaagatgtgatcgacaaaatgcgcagcctcgcgccgccgcttaaagaagtaccggaagaactgttaaccgcgtgggtggtgctggctgaggaattcgtatgcgcttctaagttcggcgattcgatcattacagcgctggctctgatgaccatgcacctgatgtttctggatggcgcaatgaagcaggaaggcgaaagcgtggaatcatactcgcagcgtgtagcgtcattcaccctgaccggggagttttcccaaacgttcgatcgcgtgtcttcggcgagtgataacgaaatgctatcaactccgtggggtaaaatgtactggcgcatgctgaaaatgcgcggcggcggcttcggccttatgaccgctggcggtcttcatcgttgcggcatgggaggttaaacgccatgaactacaaagcaattcaggcccgcgcgagtgcgggcattaagtttttcagcgatgccgatggcgtatttaacaagtacaccaaaggcgctggcggcggcatcgaccccgaaaccggggaggatatcatccctggcgaggttgtgaccacaatcaaaggtgcggtgcgggatatcaaagatcgcgatatcaatggcgaaaccatccttgctggcgacaagcgcggcttctttactcacgacgtaccaatcatggaaggtgacgaaatcgacgttgacggcgagcgctaccgcgtagtgaatgcccgcccggtgaaacctaccggaaccgttgttgcctaccgccctgttttgcgaagggtggcgacttatggctaactacaccatccgggagttcacaggtgctattgatgcatggtgcaaggcggctggtgacgcgctggaggacgttgtacgcatgacgtgcgaggatatcctgaaggatcttgtgatgcgctctccggtcgatacaggccgcttccgtggcaactggcaaatcacttttaaccgtgcgccactttacgccatcaacgcatacgaccagaccgggacgaagactatccagaacggcaacgcgaatattgcgctgttcacaaagggagccgggattacttcgatctggttcagtaacatgctaatctatgcgaacgcgctcgaatacggacactcaaagcaagcgccgaatggcgttgtgggagttgtcgcgatccgattgggcgtatacgtgactgaagcaatcaaacgagcgagggcgaaaaatgcactatgatattgcgttaaaatgcaaggcagcggcggctaaatttgccgccgataacgggattatgatcgcgagcgataacgttgactttaagccgccagccaacggcggtacgtatcttaaattttcatacgtcgaagcggattcccgatctgttagcctctccagggagtgtcgcgtttacctggggctggttcaggtagatgtgatctttaaacccggaactggcaccgacgccgcaaggttaatcgcgcaaaaagttgcaaaatatttccctgaaggtaaaatcttaggcgatgacaaattagatctttacgtaagtgagtgggcggaggtgtacggcgttcagaaggcgcaaaccgggtggttcttccccattcgctttacggtaagatgtgaacaaatggaggcgagcgggtatgcacttacctaacggtagcaagatttttattgaggccagcaacgagagggagtacgattttaagtggcttgacacaaatgatgttggcatcccaaacacttatgttctcgtattgaatcaggcggctggtgtcagtgcttttggtgttggcgatatcgtagtaatcaccgagtgcgacaacaagctgatcgagggtaacgtatactcgatccgctctgttaattgggatgtttcgagggttagggtgtggccggaataccgagctaatgatttgccagttggtagttacatttcatcgcccggaaaggttcgtcgcatttcatcatgggcggaactgccctgcgtgcagtcaatcgacaaggaaggaaacgagcaaaactggtatacttaccagtgcctgagtagcggaagggaggagaggcagaagacgacgaaatcagcgttatttatgtcttatacaatggctcacgatccgggaaatccggcgtatgatatcatgaaagcacatgaacgagataagtcattaatggctatgtatatgcacatcccaagagcaaaggaaaaccgctattggtctggtaacgtctcattcgatgacattccgtcaacgacggtaaacgaaatggagacagtggcgttacgcatggcgattcgaggcgcttataatttcttgccatccagctaactagcgggcataatggcgaggttaatcaaacatcaaacaggagtattgaacatgcatttaccaaacggtgctaaggtcttctttgagaaggcacgcggagcggagatcccgttcaccgcaatgacaaacgacgcgttaaacccgaaaatcacggtggcagatggtgcgctcgacgttaacgatatcgtaatctttaccgattgcacatggagcgactttgtaaataaagtggcccgcgtcaagtcggtgtcggctggtgtggcaactctggaagagttcgatacctccgacaccaacaaataccctacggctgcaaccggaagcgtgagcgtcgtcactgactggatcgagttgccttgtattcaggatttgggcaaagacggcaacgagcagcagtattataactaccagtgcctgagcgatgagcgcgaacagtccgagcctacctataagtcggcggtgacgcttaactacacttttgcgcacgagtacgataacgcaatctacccggtgctgcgtgcagcagacgccagcaaagaggcgaaagcgatgtacatgtacgtcccgcgagcgtccgaggttcgttattggtctggtactgcatcattcgatgacattccgactacggctgtcaacgagatggagacggtaacgcttgatgttgcactcaagggtgcgcacgtcttccttccggtggtcgcttaattaactggcggggcttgtgcctcgcctttttttatgcataatagcattcaatacataccaatcaggagattacaaaatggctaagtttaaaattcgcattggcggcgaacttccttccttcaaacttccggtaactttcacttgccccgatggcaaggatgcaaccatcaacatgacggtaaaacatcactccaccgatgaaatgaaggagttttatgaaagcgaagaaaaagcgccgaaaggtaacgtggattttatccgcttcatggccgaaggctgggatctggacgaagaatttacggatgaaaacatttcctggctgtgctcgcattacccttcctttgtcatggcattgcctcaaacgtacatggctgcgcttgccgggcatcgtgcaaaagtctaaggcgggctgtttatctaacgcttcagcctgagttaaccgatcgccagcttgctgagtatggtttacggcgatcggattacgaggctgatttagaggaaattttcttcgatgagcagaccgcccaaagttggcaactattccaggctatgcaaacgcaatggcgcattgggatgaatggcccaacggggctggactataatacattgcctatgttctttgaattgtataaaatcgacaatcgagaagcggcattgcttgacttgcagatcttggagggtgaatacctcaaacagatctacaaaaaatcacaataagcgcctacgggcgcttttttcatatgggggctaacatggctgataaagtagctggcttgacgttcggcgttgacgtgtcgcaggttgacagagcggtgcgatcacttgccgaactgaagaaccaaagccaacaaaccggggcgggtcttcagtcgctggcggacgctgagaagcgcgcgacggcgcagactgaggaaatgaaccgcgcgttgcagaaccaaaagaaaaccacggaaaaggccaagaccaatttcaacaacatcgcgggcgctatcgatcccacgatcgcgaaaatggctaacttgcgcaaggcttcggaagaactggataaggcctggcaattgggccttgtgccggacaaggaattcttccgcctgggtgctgtcattgagtcgaccaccaacaagctgagacagcagcagttggcgctaaccgaagaaggccgcgcggcaatcgctgaggctgaggcgaaacagaaggcgactaacgccgggcgtgattttgtcgccagcctgaagcagcaagcagactcgatcggcaagactcgcgccgaactgctggaaatgaaggcggcacaattaggcgtttcaactgaagcggcaccgttcattaacgccctgaagcagcaagagcaggcgttaaagaaacagcagaatgctatggggcttgctggaatttcagcaggtcaatataaaatggcgatgagccaacttccggcgcagatcactgacgtagtaacgtctcttgcttccgggatgccagtatggttagtggctattcagcaaggcgggcaaatcaaggatagcttcggcggcatcgggaacacgttcaaagttttgttgagctacattaacccgctaacagttggtgcggttgctttgggtgttgctcttgcggctatcgccaaagctgggtacgactcctggaagtcacagcgagatctagcgaatgcattggtgctgactggcggctatgctgcaacaactaccgggcaaatcacctccctaaccgatgaaatcaataaaacatcatcggctactgtcggaagcattcaggcgatcgcaacgtcactggctcaatctggaaaatacagcatcaaccagattaaggcgatcacgaagactacggcggaatgggcggcgcagaccggggagagcgaaaagaccattactggttactttgactctatcgcaaaggatccggttaagggacttgctgaactgaatgatcagtttaatttcctgaaggaagggcagctaacctacatcgaatctttgcgaaaaacaaaaggcgagacggcagcagcggaagcggcaacgaaactctttgctgacacgatggataaacgcctgaaggatatcgcagacagcgcaacgccgcttgaaacgatgtggactgacattaagaagtgggccgcagactcttggaagtgggtaggtgatcacaccgtcggcgcgctaaaccttattgttgacacggtttcatctatcatcaacgttatcaggaaactgattacggatggcgacgccatgatcgcacaattcatcgttgatgctggtcggcagttgcagaaagtgcctggcatgggtgactttgggaatgattttcttgcacagcaagaacagctaatcaaggattccaaagccaaatcagcggaactggcgaagaccattgcggagcagcaggcaaggatcgcgaaaggcgaaatgggttacattgacgcggccaaaaacaaaaacgtgtccggcggctacagcagtgcaacaaaggataaggtaaatcaggaagaaaaggatatcctgaagaaccgaaacgccagaaaggagcaggcagacgccggggttaagatcgatgaacagtatcagtcagaattgctgtcattgcaggcgcagttgaaagtattgcagcagcacaaagggcttgacgacaaaatcagccagcagcgcaaagactactttaccactgtcgcaaaattccaggtgctggaagaagcgagcgccaagcgtaagctgacgcagagcgaaaagcagatgttagccaataagcaaagtatcatcgctatggcggaacagaaagcgatcgtgggcgatcagattgtccggcagcagcgcctgaacgccttgcttgacaagtcggtgaagtatcagaaccagatggctgagaagacgaaagcgcttcaggataccgccgggatggggagtaagcagcaggagcgctacagggcaaatgcgcagatggcggcggactggaagaataacggaggctcgcttgacgacgcccaatttaagcagatgcaggcagcaagcgaacagttttacgcgcagcaggatgcgcagatgcttgactggaaagcgggattcacgcatgcctgggctgacattggcaacgaagttaatgacgtgtactccaatatcgggagcatcacccaaaacgcatttaacggaatggctactgtgctaactgattttgtcatgacgggtaaggccagcttcagcgacttcgccagaagcgtgattagtgacattaccagcatgctaatcaaaatggcgctgttcaatgcaatgtctgctgcattcggcggtggcggtacgttcagcttcgccagcatgttcagtaaagggttcgccaacggcggctatactggtaacggtggcaagtacgaacccaaaggcgttgtgcatggcggcgaattcgtctttaccaaagaggcgaccagccgattagggccggaaaatttatacaggctgatgcgtggctatgcttccggcggtctggtaggctctaacggttcgtcaggatctggtgtgacgaatggcgggaatgttgcagcatcggcagcaatggtttttagcatgggtgacgtgaacatcacgatgggttccggtcaggatagcaagggcttagagcagggagtaaggcagatcgtgaatgatatgttcacggaggcactgagccaaaacggacgcattgcgaaatacgtaaacgagaaaacgaggggttaacagtggattctttttcctggtgtactcaaattcaaggaggggcggcgaaagtcgccgtttcaaacaacgtgcgagcggtaagtttcggcaatggatatatccagactgcatcgagtggcatcaacacaaagcgccggacggttccgatcgtttatggcggaatggattgggaggaggtttatgatttttgtcaggatcacgtaacgaagccctttatctggacggcaccagatggaagaatgggtgtattcgtcgtaacggcagactctgtgaccctcgcgccgctgggcggtgggttatgcgaagtaacagcagagtttgcggaaaggttctcttcagccggatagcacaaagcgccctttacgggtgcttttttttggcctatgatctggagtcgataagaggaggaaatttatatgacaactaacgtttcaaaagagtttgcgaactgcttgcaaaagctgttcccaggcgagatcttaacgctgattgacattgacgcaacaaagttcggcggtcaggtctaccgattccacaacgagaatgtcgcctactcaaccgaagaacttttggcagcggttaacggcggcacgcttaaaccgaaggcgatcacgtttcgcggcgagcagtacggcccgcgcccgtttgggatcggcggtatcgcaatgtcaagtgatggcacggtagaaaagccaacgctgacggttagcaatatcgatgcgcaagcgagtgctcttattcgctcctacaacggcctcatgcaagcgaaagttacggtatgggttttggtcaaggatttgctgaaagaagatggtagcgtcgctgagggcgattttcgtcggttcgtttactatatcgaaagacctaaacaggttgacccgcagaaggctacgtttgaactaacgtccgtcttcgatatggatggcttgatgattccggcccgcctgactcaaaccgtttgttattgggcgcaacgcggctggtacaaaaccggaaagggatgcagttacaacgggcaaaacggatactttgacaaatacgggaataaggttgatgatcccagccaggatgtttgcggtggccttgtttcgtcgtgccgattacggttcggcaatgaggctttggattttggcggttgcgctactgcaaccttgaaaagcggacggtaatatgttaactccaaaaatcaaaatgcagatcatgcagcatgcgaaggaagtttacccgcatgagtgcgcagggctggtaacgcagaaatcacgtgtgcagaaatatcaccgactcgataacgtttcgccggatcctgagaacgaatcaatgccggacgaaacacagtacgcgctggcgtcactggaaggcgagccgatcgccttcgttcactcccacactggcgacggggcaaccaccgttccgagcgccacagatttatgcttctgtgatgaatctggcttgtcgtgggttatcgtgtcgattccagaaggtgatatgcggattatcgaaccgaagcgcaggccgctgattggtcgcccctgggctttgggcgcgtatgattgctacggcctggtgatggattttcacaagcgccacggcgtcacgctgactgaccgccgcctgccgttcgaatggtggaagccggaatacaaagaggatctttaccgcgactactggcgcgaagatggattcatcgaaaacactggcgatcccgaagtgggcgatatgattatcttccagcttcaggcggaaaagtggaaccacgctgggatttacgttggaaacaataatatccttcaccacgccttcggcaagctatcccgccgcgatatctattccgggtggtatgagcagcacaaggttttaatttgcagacataaggatcttaaacatggcatcacatacaaagacgattaaactttccggctcccttgggcgtcggttcggtgtcttccataacctcgcagtcgattcagtcggcgaatgcattcgggcgctatcctaccaagtggaagggtttaaagccttcatgcagagcaaggttggttctaacatgcgctttggtatcgtcgcggacggaaaaccaatcagcacgaatgactttgcaacgttcgccgtagcgaaggagatccgaatcatccccatcccgaaggccagaaagaacggcggattgttgcagatcgttatcggcgctgcgattatggttgcggccttcttcactggtggcggttcgctggcggctatgggcgctttttcgtcggcggcttttatggctggtggctcaatggtcttgggtggcgtaatgcagatgatcgcaccgcagatgggcggcaacatgcgatcgagcgagtcgcctgaaaataaaccttcgtatgcttttggcgggccgattaacaccacggcggcgggttatccaatccagttgccatatggttacagattggctggcggtgcgctgttcggttcagggtcttacgccgaagataacaactaattaagcgattcgctttttagcctgggggcatagcctccgggctttttgtcgtgtacaattgcaaaactattaacaggaggctaaacgatgactaatatcaaggcccgcaagggcggctccagccagccgcgtaccccggtagaaatgcctgataacctgatctcgaaagacaagatcaagttattgctggccgtttctgacggtgaagtagtggatgacttcagcctgaagcagttgcatttcggcggcgttccggttcagaacgaagacgggagctataactatgagggagttattgcagaatttcgccccggtacgcaaacgcagaattacatccagggcttcagtgaatcaagcgctgaattccaggttgcacgcgacgttacctttaacacgccgtacacgctgacggtatcgaacaagaatctttctgctatccgcttccgcctgttatggccccgcgtgctgacgcaaaaagataatggcgatatggtcggttcggtcgttgagtacaagatcgaaatggcggttgacggtgcgagctatcaaacctacttgaccgacaaaatcgacggtaaaaacacgactggcggttacgatcgcagtattcgcgtcaacttgccgcaagacttcacgtcgcaggtgcttatccgtgtaagccgaattacgccggacgctgacggggtgaaggtggtcaatgccttccaggttcagtcctacgctgaggtgattgatgctaaattccgttacccgctgacggcaatgctttacgttgagtttgatagcgatttgttccagaaccagatcccgacaatctcgctcaagaagaagtggaagattatccaggttccgagaaactacgaccctgttaacaggacatatgccggaacgtgggacggaactttcaaatgggcgtggagcaacaacccggcctgggttctttacgacctgatcatgaatcagcgttatgggttagaccagcgcgagttagggatcccggtcgacaagtggtcgctctatgaggtgtcgcaatactgtgatgagcttgtgccggacaatcgcggcgggatggaaccgcgttacctgatggatatgatcgtgcagtcgcaggtagaggcgttccagttggtaagggatgtttgttccgccttccgtggaatgacattctacaacggggaaagcctttcgattatcgtcgacaagccacgcgatccggtttacttgttcactgctgataacgtcgttgacggcgtattcgtgcgaacttttccgagcgaaaaaacgatgtacacatcgtgcaacgtgatgttcgacgacgaagaaaaccagtacgagcaggacgttgaaccagtgtttaaccctgacgctgcaatgcggttcgggcataacccgacaagcatcacggcgatcggttgcaccagacggacagaagcgaaccgccgcgggcgctggattctgcaaactaacctaagcgcaaccaccgtttcgttttctacaggtcttgagggcatgatcccttcatgcggcgatgtgatttacgttgctgatccgcattggcaatcagcctttaacctggtgttgtcaggtcgcattatggaagtatcaggaacacaggtgtttttggctttccgctgcgacgcgaaggcgggcgatacgctgattctgaacactgacgacggcaagccagtgcgccgaaccatcgccaatgtatcggcagacggtaagaccatcacgctaaacgtcggatataactttgacgttgcgccggacagcgtattcctgatcgaaagtgaccaactggcggctgaacagtacgttgttaccagaattgagaaggggagcgatgacgacgaatttactttcgcaatcacagccacccaatacaacccgaacaagtacgacgcgatcgacaacggcgtaatcactgacgaccgcccaacgtcggttgttgacccggattcaatgggagcgccggaaaacgtgtcgattagttcattctcacgcattgtgcaggggatgagcgtcgagacgatggtaatcggatggtctgccgtgcagtatgcaaaactttacgaggtgcaatggcgtaaggatggcggcaactggaacaacgtgccgcgcacagcgacaacgcaggttgatattgaggggatttatactggcgaataccaggcgcgcgtaaggtgcattagcggcggcaatatcgcgtctccgtggtctgctttggctagtgcatcgctgaccgggaaaattggagcgccgaaagggccaattaaccttttcgcgtcggataatgaaatctttgggattcgcgttaagtgggccatgcctgaaggtgcagaggacacggcatacattgagctttaccagtcgcaaagcggaaccgatcaggatgcaagcctgcttactctgattccttacccggcggctgaatactggcactcaattttgcccgctggctacgtgaacttctataaggctcgaagtgtcgacaggatcggcaacgtttcaccctggactgattacgctcgcggtatgtcatcgactgacgttagcattatcacagatcagatcttggatgaaattctggatagcgatgccatgaaggaattgcaggagagcgcacaggacagcgcatctaaactcaacgactacgcgaacagcatcattcaaaacgctttggcaaatgatgcagacgttaggaaaatgacgaaggagaacggtaagcgtaaggcagagatcgcgcataccacggtgctgatcgccaacgagactgaagcgcgggcggctgagatcacacagcttaaaacgcagattgatgaggatatcacgtcgcagattacgatcctgaacgaagcgctggcggatgaaagcgaaacgcgagcaacccaaatcaaccagttgcaaacgcaatttggggaggatatggaagcagggtttacgcaggttaacgaggcgatcgcaaacgaaagtgaagcgcgcgcaacgtccgaggcggcgttagatgccaaaatcggcgagaactccgcagcgctggcgcaaaaactggattcgtgggccaatgttaacggtgtcggctctatgtacaccatgaagttaggtctgaagtacaacggacaggaatatagttcaggcatggcgttacagcttacctcgcaagggggaggtgttgtttcgcaagtgctgtttgttgctgatagatttgctatcctccgcaatgcatcatccggcgcttacacgcttccgtttgttgttcaaaatgaccaggtgtttattaacagcttgctcgttcaggatggctcgattaccaacgccaagatcggatcgtatatccagtctaacaactaccaggagaatgtagcagggtggaggcttgataaaaacggaacgtttgtaaacttcgggtctacatctggacagggggccatcaagcaaactaaccagaacatcacggttatagatggcaacaaccgcgtaaggtgtcagattggactaatcacaggaacgtggtaacattaacgccgggagaaatcccggctttttacatagaggaggctgaattatggcttacggttttcaatcatgggacacaaacggcaaccccaacaactacggaatctttcctgtttcagttgctggatatatttcgctttctgaaggccagaaaagtggctcatggtcatttaacgttccgtctggattgcggttaggttttttttgggtggctaaccaggacaaaagcgggttatcaaagagaaccattaccgtttcgggaaatacaattaatgttggtagcgcggctgatgactcctttggggtaaacatctatccagcaacgcagggttttattgttgttcaaatgttgagttaatattatggctgattatggtgtactacttaccaatgatagcggaaacgtgtgggtttcaccgcaaagcatcccgttggcactgctatctaagcagtcaattacgctaaagggcgggacgaattccgatgaagtaatatctgtaacttacgatacagcgcatccatgcgtcccgttcgttgtttttcatggcgcgtcgccaaatggcgcattcacgaaaaccaggtattcaggaaatacttgcagcgttgttttctctgctggcactcgcggaatttatgcagaggtgtatttcttctctgtgttcccgcagccaaaccccggatatgggcttgctatttgggacgaaaacggaacgttaattcttaccaatgaaactcgaacgctatcagatgttcaaacatacggcacaggttacaacttaaacgtaaccaatggaggtaagtgggctgttagccctgtgcaattgggggcgattgttggtgtaattaatgatccgcttccaagaccatttgagggggattattgcgcggcggcgttctttaatggaggtagcacgcaacttgctgcatatctcacccaggccccaggtgggactggcggatcatttacatatgttgatatgaaaaatacatgtattgctattaattgcgcaaggtatgactaaaagaaaaggggccaatcggcccctttgttacatcccaagtttctcctcaatggctgatagccgcgcctcgaatcctttcgcaataaacatgtttaattcatcgagtcggaacgaataacggtcgccagccggaa

SEQ ID NO: 11 - DNA, 8158 bp, Unknown
  bacteriophage genomic DNA
ctaatggtctccacggagtctaacctaatgatagaggctgtaaggattacctaatgagaccctttaagaatcctacagaaaaatctctgtgagtatctcatagtgtaagaacccaaagtacccccgtaggcctccctcagtcacctctcctcgcctcctaatgtatcatgatgtgccaccttgagtcaaccttttgttcaaccttgagtgaatcttagggtgataccacaagatgtagtgccttgagtagcctaatgatactatatgtagtcgtctccgtgtccctatctgtaagtgacaccttgagtcatctcctaatgtctatcctaatgtgagaccatcgaccactatcctaatgattactctcagttgttgcctaatgtttatcagagaccattgggctacgtctcaaaggttattcactatctaccttgtttagcagtctcaaaggtaaagagacacatagaatcaactgagtgcctactatgaggctttcgggtctcaatgtcaacactcttattacgactcactaatgggtaatggtcattgattattgcccttctctatatgtctacttaaagagactaaaagattaacttagagtgaaacttattgttgacttagagaatcagctatgtcactattcatctcgtcaacagcgacaagggaaaccagatagctgattgataccgggtcaagcggtgaagtagacagcctgataagtcatacgaaaaacaggcattgacaagcagtaaagcagtttgataggatgtaaagcgtcaacacggtgagcctctgaaacgacattgagagacgtcaagttcaccacgacgataagcagtaagcagtacagcacgacccgctctttaacaatctggatgctcacaaggcgtgaacccacaagggtttcaaagtgattaacttacagggcgcatggtgcaagcgtgttaccttgtgtgatactcacttcaaactaaaggaaatcattatgattcacactaacgaaccagttaacgtgtactacgtgcttgtctctgctttccgggctggcctgcacaaccttgataacttgagccgtcatcgtcgcctgttgaactctctccgcaacaacgtgttagagtatggcgtggtcgagtcgtcagacctttgcggatgctaccgtgaagcaggtcaggagtttgccagcgaggagcagacaatcagagttcgctgcactgagaaacatcaagcggtcagcgttgcacggttggcatgtaacgactacgaacaagattgtgttctggtctacaagtcacagactcacagcgcagccctgatgttcgctaaaggtttggacggctggcgcactgaacaaatcgggtcgcttcagaaggtacacgaaaacatcgaactcaacggtaactatacaatcgacgagttcggtcaggcgtggcaagtacagtaagagttagcctacaggtcatgcactcagcgtggcctgaatgattaactttaacttgaggtaacacatatgaacgaatactctggctggttcttcacataccgggcattctatcggcacttcggagtgcaccacttaacgggcctgactcctctcgggctgctcactctggctgttatccttttcgcactctacaaggtggcaaaacatgttattcgcgctcatcattctcgtcggttactccgcaatctttctgtacatcctgaacgatttccgcaagggtctgaaggtacacaaggcaacgtttagctactgtcacttagggcttatcccacggttcacagtaagagagcgcaacggtcgattcaaacgtaacaaggtagggttctggtatgtcgcaacgcactgatagcaaggcggagtttagtaacccgtcacaactggctcgcaacctcggggtgaccttgcggtctctcattaagcagcacggcaggccatactatggtcgcaagtacgctggcgctgtctcataacactcacacttaaaggtacactgaaatgatatgcactaagtggagacacgcacggtatgcagtccaaatgatggcatatggtgcatctcgcagctacacaaggcgtaaactgatgcgcctctatcgtctaccagcacgcaaggcggcaatcgctgttaagtgggctgaatacatgctctttacctcttacaactaacactaactgaaggtacactgaaatgacatacactgaattagctcaacgcctcgcagacatccgctcactgagtatcaacgagctggctcaacgccaaccgatgcttgtcgctctggtagctgaaatcgtgaacgaagagacgatgaacggtgagttaaccgctgagaactccggcaacgctctggagtgcatgaaatactggctgacgttgaacgagaagttagccgatgcagactttgagcgcctcggtaatggtcacttcagtgcagcctactgtcatccactgttgcccggtaaggtcatcaaggttggctttaagaaagaggattcaggcgcagcgtatgcagcgttctgccgtatgaaccaacacatggagggtatccctaccattcacgacatccagcgtcatgcaggctgctacacggtggttcttgatgaactcgaaccgctggctgattggtgccggggtgagtcggacaaggtgcagcaccactatgagttagcaaagaccatcattgacatcgggtctaaagctggcgcagcggagctgatgaacaaataccctctgagtccacgctttgaggaaacatgttgggccatccgcacgttcttcagcggcattgcatcgttcgatgtgcacagcgggaacctgatgaaaaacaaggccggtgacctgattatcactgacccggtatccttcagcgctgacaagctgaaagacgacaagttccattgtgatgcagaggagctactcgcagagattgaggcattcaaggcgagtgagctgattgagcgctgcaagatgcgcaaggctaagcgtgaccggttcgggacattccgtcgcaatctgagactgaacgcaaaggctaagcaacgtcgcaaggtcagagcacgtaagcacgaagcggagttcgctaagatgcgcagagataacaagcaggcgcagcgtgatgagcagttagcacaaatgattctcgggtcgcaacattgggcgaacatgtggatacgcaatcacaactcaatggtcgctatggtggaacgggacatcgccatcaaggcacgaaatgcagacctccagaatattgcggtggatatgaaccgaccgctacgagtagacttgttcttgcatgatgcattcctaatgggttaaggtatatcttcagtgtcatcctccagcggtggcactcatagataaactttctaaacaacgaggcaatcaatgaacgtaatcaacgcaccaaagaatgacttctccgatatcaaaaacgctatcatgccgttcaacgttctggctgaccattacggcgaacatctggcggcgactcagttgcagcttgagcacgaagcgcacactgaaggcgagaagcgtttcctgaaggcgatggaacgccagattaaagcgggtgagattggtgataacgcggtggctaagccgctgctctcctcgctggctccgaagtttgtcgaggcgtggaacacgtggttcaccgaggttgaggctaaacgtggtaaacgcccggtcgcattcctgaaggtccaaggatgtgcacctgaagcagccgcctttatcacactgaaggttgtcttagcgtgtctcaccaaagaggagcactgtaacctccagtatgttgccagcaagattgggcgcagcgttgaagatgaactccgcttcggtcgcatccgtgacgaggaggcaaagcactttaagaaccacatcgcggacgcactgaataagcgagtcggtcaggtctacaaaaaggcattcatgcaagcggttgagggtaagatgctcgacgctggtcagttgaaacttgagtggactcagtggaccccagaggaaaacattcacgtaggcgtcaggatgctggagctgctcatagcgtcaacaggtttggtcgagctgacccgcccgtatgctggtaacgttgagaaggatggcgagtacatccacttgatgcctgaatacgttgaaatgctctctaagcgtgctggagcgctcgcagcgattgccccgatgtatcagccatgtgttgtccctccgaagccatggacgcagcctgtaggcggtggatattgggcggcagggcgcaagcctctgagtctggttcgtaccggttcacgtaaagggctggagcgttacaacgatgtgcacatgcctgaagtgtacaaggcgattaacactgcgcagaataccccatggaaaatcaacaagaaggtgctggcagtcgccaacgagattagcggatggaaacattgcccggtctcagatatccctgcactggagcgcggagagttaccacaacgtcctgaagatatggacactaacgaggcagcactcaaagcgtggaagaaagcagccgctggaatctaccgcaaggagaaagcgcgggtctctcgccgtatgtccatggagttcatgctcggtcaggccaacaagttctcgcagttcaaagcgatttggttcccaatgaatatggactggcgcggacgtgtctacgcggtcccgatgttcaacccgcaaggcaacgatatgaccaaaggtctgttgaccatggcgaaaggcaagccaatcggtgagaacggtttttactggctgaagattcacggagccaacacggcgggcgtcgataaggttcccttcccagagcgcatcaagttcatcgaagagaaccacgcgaacattctggcatgtgcggctgacccactggctaacacatggtgggctgaacaggactcacctttctgtttcctcgcgttctgctttgagtatgcaggcgttgaacatcatggcctgacctataactgctcgttacctctggcgtttgatggttcatgctctggtatccagcacttctctgcgatgctgcgcgatgaaataggcggagcggctgttaacttgcttccaagcactcaggtgcaggacatctacaaaatcgttgctgaacgtgtcttagagattctccgtgaggatgtaatcaacggcactgacaacgaggtggagaccacagagaacaaggagaccggcgagattctggagaagctgaagttaggcacgaaggaacttgcgggccagtggctggagcatggagtgacccgctctgtaactaaacgttcggtcatgacgctggcttatggttccaaggagtacggcttcagggaccaagtgttggaagatacgattaacccggcgattgataacggcacgggcgcgatgttcactcaaccgaaccaagcggctggctacatggctaagctgatttgggatgcagtgacccgtactgtggtcgcagcggtcgaggcgatgaagtggttacagtctgcggctaagttgctcgcggctgaggtgaaggataagaagacaaaggctgttctccgcaagcgttgcgcagtgcactggaccacgccagacggtttcccggtatggcaggagtataagaagcagattcagactcgcttgaacctgatgttcctcggagttatccgcctgcaaccaaccgtgaacaccaataaggattcagggattgacgcacgcaagcaggagtcagggattgcaccgaactttgtgcactcaatggacggctcgcacctccgtatgacagtggtcaaggctaacgaagcgtatggcgtggagtctttcgcactgattcacgacagctttgggaccatcccggcagacgctggcgcactcttcaaggcagtccgcgagactctggtagatacctacgaggagaatgatgtgctggctgacttcgcggagcagttcgctgaccagttgcacgagtcacagttagactcaatgccaccaatgccagccaaagggtctctggacctgcaagaaatcctcaagtctgacttcgcgttcgcttgatgtgaactaatacgactcactaatgggaaccctctggggttctctactttaagatactttaagattaactttaagaggctctaacattatgaacatcatcaaatcattcttctctcgcatgacttccgacaaagtggcaacccttgaggcaaccgtgcgctgtcacgaagcagccatggagttgctcggagctaagtataaggagctgatgaagatgcgctctgaggagatgcaccagcgtgatacagacattgcgagacttcgcggtaagctgcaagcgcttaaggttcaacgcaaggatttgatgctgaccagtatccgattcactgcacgcctgccggatggcttcaagcgagacactgagttcaagctgggtctcggaccgtgtggcaaagtggtcgaggagcttcaggtctggcgcaaggatggcgagatgcacattaagcagtggcatgatgattgcacatacaaactgttcatctataaggaacaggacattctgggtcgcatcgtggagaccatgggtgaggtggagttctctgagtcttcagcactcggtcaacgtcaggcacgagcaagagcagaccgggagcggctgcgcaacctgaaccgtgcgggtcgtctggtcccacgcttctaatacgactcactaatggagaacactctctgagttaaactcaaggtcatctgcgggtggccttcatgattaacttaaccaactacctaaagaggattacattatgcgtaccaacttcgaaccaatcaccaagcgtaactcaatcgttgacgaggcaggcactgagtggcaggaccgcaaggaaaatgcccgcaagcgtcactctaagctgaacaaagtgaaacgcggtgtatcgaacaaacgcaactggcaggaggcaatcgcatgatttactcaggcaacctgaacgattacaaagatgcggtagcgcgtctggaagaggaccacgatgtaactgtacgtgttgaatgcctcgtctacgaagacccggttaagttacgccgggttcacgctgaggttctccgagtgttcacgcgctcgggtcagcgggtccatcacagaacgttcgagcaccacgatgtcgatgtgcgtatcaatgcgcagactgaatggctccgtaaggttcacagcgacttgaggcactggaaatgacaccacttgaaatcatcctaacagtcatcctcgctatcatcttagggttcgtcctcggttacatgagcgcggacactgagtaatacgactcactaatgcgagagctaaactcaaggtcacttaacggtggcctttgtgattatcttttgtctactaattaacccaccaagaggattaacactatgaacattttcgcaacccggccatacaaagcggtatccttcgtagaatcagcggtacgtaagactctggaaaagtgtggctacctgatagcggattgtaagtatgatggcgttcgcggcaacattctggtggacaacgtggctgacgctgcgtggctctctcgtgttggtaagctgattccttcgctggaacacctgaatggctttgacgcccgctggaaggcactgcttaacgatgaccgctgcatcttccctgatggcttcatgcttgatggtgagctgatggtcaaaggcgttgacttcaacactgcgtcaggcttgctgagaaccaagtggctcaaggctaccaactggatgcacgctgctgagttctgcaacaacgcactgatgccggtgaacagtaagggcaagtgtcctaagctgccattctacctcgctgcgcaaaagctacaggttcgtctgtatgcagtcatgccgatgcacattgctgagtccggtgaggactacgatgttcagaacctgctcatgccttaccacgttgaggccatccgtgagctgctcgttgagtacttcccagagattgagtggcttaccgctgagacctttgaggtgtacgatatggagtcgctggtggaactctatgaggaccgccgtgccaaaggtgatgaaggtctgattatcaaagacccacaaggtatctacaagcgcggcaagaagtcaggctggtggaagtgcaagcctaacgatgaggctgacggtgttatccaaag

SEQ ID NO: 12 - DNA, 44488 bp, unknown
  bacteriophage genomic DNA
ttaatcgaaaatggaccacttgccgacgcctttccactcccacccttccgatcggacggcctcgaacattcgcctgccgatcatatcgcgataccatagccaccacatgcgcaaccgggtagggtgctccgtgatgccacggcgcttgtatatctgaaacgtcatgcgggtaatgctggcggcttccaccgcgggccaaatcaggaatacccataccaacagcgccagcaccgtagcaaagagtgtcgcgcacccaaaaccaaaccaataaatcaaatcgtgtagcatcgaattgccccttccggtttgccaatatggcgcgcccatgcacgcgccacgaagtaattgcgaaatacccgaccgcctatctcaaagaggttatgcatcagcatatcacgaatcacagccgacacgggatacgacctccagatgtgggttatggcgtggcgcccagtgcgcttgcttagtagccacattacgtagtttaacctggtaatgggttacggcgaccaccaagtataaatcgcgggttaatttatcccgcactaaatcgaatttattcatttcagcaccacacgcaacgggcttacggacttcatgctaccgtcggggtagaccaggagcacgccgattccgtggcgttttgcgtccagattagccatgcgcattgcatcgcattgctgggtaatggccttccgggcgttgtcgatatgctcgcgcaccttgctctcgtcgtatttggtatatgggtgctccgtacgggtgatcgctttcgccacgacgccagggcgcttaggtgtgtagttccggcctacgcgggtgtaattcaccagggtggcggggttaatagtcgcgcctgccaccagagtgctgtcgatagtaatccattccgtcccgactgacttcacgacccaggtgtagtcattgccatcacaacgcagcacatcacctactcgtacgtcgtggtgcactacctgcaaatgctcatgcagggtggctttcttgtaccagaatacgcggtcgctggcttcatggtacatgcgcacatagttcggcagcacttcgatcggggtaaggaatcgcccattatgcttattgcggaatatcattttcattctgtcaatctcctgtagttacgaactaatgtgaggcgcgagatagtgcggcgagtaccacacttagggtgtgaaatagtcacgttgccgtttgcttcttctgtcacgaagtaagtcagtcgcgtggccttactccgccagcgttcaggttgcttgttcatttcgccagtctccagtgtttgcctacccgctcaacggcaggctttcggcgtaatgtaatacgaatccccattggttgcaaggaagtccgcaccctgaaatcgtgttgtgctgcgaactggtgcaagtagcgagtctgcgtcagtggctttacgtcatcgcgatagcaccagtacacagaatcccccacattcgcattcttagcccatattcgtatgcaatgcaggggaatatgccacgaaagctgttttgctcgcctacggcccattttggccccttatttcgcaagctgggtgaatagctcacgctgggctttaatccgggcgacgtttgtcactgccttatcgccaataccgaagcgatatgccaggcgctcgcgggagaatgcacgcgcgtattcgtggattgccttcgccagcgtcttcagttcgtcaaggctggcatccatgccgtcgagcgcatacatgattgcctgctgggccagtattactacatgcgccgcgcggtctgcgttgccgttcagagccttcgcttcgtccagcttcgccagggccattgcgtaattccagattaatgctctcatcgttcagtcctcatgttggtgtgcaaccaatattaatcacgcgcatgaaaaagttgatcgctatctgctgcaacggcaaactgcatttcccactctccattatccaacccgcattggttgcctagttcatccgcgaccgcacttcgcatcatgctgccgtgtattttgcaatccccggattttattcagtctcagacgaggggggccattgacccccgtctagtctgaaagactggggtgctgtcccgctgtcccgctcctctggaagccgcgccatccggggcgggacgggggtgctgtcccgctttgtcccgcccgctttttgtcccgctttttgtcccgcttactttatgcagttttattgcataactattcataataatcacactacacggcaaccaatacgaccagttaaaaacacccaaaatggcaaccaatgcgcgcaaaatttaatcttttagcgatatgggaattcccatatcggcaaccaatacgcgcaaaatttaatctttcaggtcgtcatcggtcgcagaaagcgtgatgggtatattcgttttgatgactatattcgacgacccatagatggccccggtgtgcggatcggtataaaaacctaacactccgcgctcaaccatatcgtctattgccttcgtagatgtgccaccttttgccaatcccgcctggcggacaattgccgatttgctgaatccggtatggtccgggttatcttccatcagtttttccagtgccgcataaagcactttctctttttcgttgcgcggtcctgcggcattctcgtccttaaccgcggccttgccagccgccttcgcctgttctatagcgaacggtgccagggcgaccggtacgaggtagagagtctcgtcgcgtggcgtggaggcaatcggcttgacgtcccatccggcaaccacgtcgccgaagtctggcccggtgctggtggactggtgcgcctcgaacgcttctgacttgcggagatccaccttcaccttgcacttgagcaggacgaagccacgcggcgcttgcttgatgccgttacgtgccttttcgtgatacaggttcaattggcctggctggttgtcgtccggctgttccaggaagaacgcagaatcgacagcgccatgcagcgcgccggacccgcggggggttctgctgccgtttgcacccttcgccgggtggtggatgacgcccgcactgccacctgtattttccgcgatggccttcagcgctttgaccacttcacccatatcgctggcgttgttctcgtcgaacggtttagcatccgcggaccgcaacgcaacagtctggttgagtgagtcgaacgccaccaggccaaccggttcgccgttagcggtgcggttgatgaagctgataacttcacgcaagccggatttgctggtgatatcccagccgcgtgattgcagatcgataatgtgcagcttgtccaggtcgtgctcatatttaatctgcaatgcttctttgcgctggttagaggcttcgccaccttccgcgtcgaaatagaagcaatgagactggacgaccttcgcaccgccgaacggaataccagcggcaaccgcgcccatctgccccagcacgtagaacgatttaccgatgttcgactcacccgccatataccaggttgatttaaagttaatcaacccctcgataatcgggtcgtgcttactgaacagcgcaaccggctcgttatccagatccgcatcggtgcacacgccgtattcttcgccgtcgccaaccgcatccacaatatgttcatataaggattcgacttcctcgtcgtccagccctgggaggatggcggcgatttgcttacgggacatgttgtgcggctcgacgttcaggtggtccggtatcccgatgagacgtagcgccaggtgctggtgtctgttcagttccgagcaacactcgttgccggtgtgcatacacttgaaacggatctcgccatccttaaccatgatagcggtggacccttcaccactgtgcaggtgttcgttcgggcatggcacttcataaccacgaccggacgacagcggttcgaatcctgcctggaagcaccagtccagaatgccgtctgccactgcgtcgtcgccctgggtaagctcgcggcgtacttcctctttttccacccccagcttatcagccaggcgaagcagacgacggacgcgggcacgtttgccgtagtgacacttaacaaccgattgctggtgaggcaggtacataaggcggtttgtgtctttcgtgcaatcgtcgaagtccacatctgacaggcccagttggtgtaatagtgcatactggacgcggcccaggtcttccgccggtacaggcttgtcagtgagcaccaggaaacgagcgcaacgcgtgccgcctttcagcgggtggcggtcgccggtagtggtgtggaagacgtgctccagtcccgcgtcgatgaacgccttacggcagcggcgcagggtgcgggtgtcggtgcggtcaatatcaaagaacaggatcgagcggtccacggcactggtcttgcggcgtaagccgtcacgggtataagccacaataccatcagccttacgcttgcggcgcgcatactccgctttatcttccgtcttgttgatatgcaccgaggatatttctttcgcatcattaataaattcgaaaaactcatcggtggtcatctggaagttttccgccctggctttttcgccttttttagcgggtcgtgttacagcgaatttaattaagctcattgccgtggccttacttagaagttttattattgcgtacccaggagcgcactgtgctctgattaattccggttagctctgcaatcatcgcccatgatttgccctcggcgcgcaaacggataacctgttttttgtattcttccatttcttcattgtgtttttgcagcttgcttgctgccgtgccgttgagcaattccagcttcgcggtaagctccttctcagcacgcgataatctggacacttcaaataacagagtatccaccgcatttgtgtaataccaggatttacccgcttcgccgcggattgcattagataacacttcaattgcttctttgatattcataattcagtctcctgttggttaatgaccaatgaaactacacctaaaaccacaaggtgtcaaatcctttggatattgaaacgggcgcgcacgcgtgtaataataattcccgtctcattgtcttgtctcttattggttagcgccggtgcattttgcctcggcgctttttttttgaattagttgttgacacccatcctgcaaccaatctatcattcactccgtcgacaggatgcaggacgcaaactggagaggggcaacgaaggggccggatcgaagtgtcaggattcccaaccgtgattatataaccaggtccactacccgaacgggagaacgcgtaacctggcaatatgttaaggccaccgacgaagttaactgccgacacctaaacttaaccaatcggagatataccatgtttgagcaaatcgtaaacctgatcactcgcggagtagtagcactggaaaccattgcaaagcattatgaaaccgttggcgctgccgttggtaaacaggaagataagaagccgtctaaggccaaaaaagaagttgtcgaagatgacgacgatgaagctgaagacgaaaaaccggctaaatctaaaaaaacaccggcgaaatgtaaggctaaaaaagaagtcgtagaagatgacgacgacgatgccgaagacgaaaaaccggctaagtctaaaaaagcaccggcgaaaggcaaaggtaagaaagatgccgatccgctggcagagatgcgcgacgaaatcaaacagtatgccgcgattattgccggtggtgacgatgacgacgcgaacgacgaatttgatgatctgctggaagcgttcgaaattaaatccatcgccaagctggaagacgacgacgttgaagacttccacaaagatttaaaagaaatcgtcgaaacctatttcgaactggaagattaatgtattccggcccgctaatctgcgggcctatttttagaggacgagacaatggcacgcttcacgctaatcgaggcggtggactcccgcgaccagcgcccgtactattggctattcgaacgcatcggcagctttcagtcacgcgttgccgtaatagataaacgccgtaacacccccgcgcaaattaagcgcaccacctttactaaccccgacttttatatttgggcggattccaatctggaatatgttcgcttcgcagttgcatccgaagcaaaaacaatcgaccgctgggagacaaaataatgaaattcttcgtcatggcaacttgccacgaattaaacgatcacacttcttttattgttgaaaacaccaacgcaagcaattgctttgtggacgcgcaaaatgaagttaagcgccgagtcgaaaaagcgggcctggctaatgtgaaatatgtaattgtccagtttacacgggtggaataatggcgattaaaccaaaacgtaaaacgcaatccggtagcaacacggaacactcattactcgggccgtccggtgctaaaaaatggatgggttgccctgccgccctggtggtggaaaaagatatcccgaacgaatccgggcaagcggcgattaacggtacgagtatgcacaccgtatcagaggtcgtgctaaaccgcattatcgccggtgagaagctgataaccgcgaagacgtataaagggtgctacgtcgagaacgaaggcaaggggccagtaaaggcccacccgaaagcaccgaaaggcggcgtactggtcaacgacgacatggtgaaacagtgcgacgcgtacatcgaccactggcgaccgctcctcgaagtggcggagtttgttcagcttgagatgcgcgccgatctgacccgcgtccttcactcaggcttcgagatcgacggcaacctggttaagacgttcggtactgccgatatggttatggtcatgaagaagaccgacggcacgtacatgctgattgttggcgacctgaagacgggacgacataaggtcgaggcgaaagaaaacaaacagcttatgttgtacgcgctcggcctgctgcgcaagctgaaaactatgtacgacattacgaccgtgcgcctggttatcttccagccgtattgcggcggggcgtcggagtgggatatttcggtagaagccctggagatattcgcgaagtttgcgtccaagcgtgctatcgccgccctggaagcgtacgcccgcggcaaaaagggactcacccgtgccgacttcagaccgagcgttgatgcgtgtcagtggtgccgatttgcggatcagtgtagcgcccgcgctaaggccgcaatcgacacgatgaccccaccaacggcaacagacgaagacctgggcgacgacgtgagtattgcgacagaggaagaatgcgccaatcacgatcgcaatatgacccgcgaagcccgcaaagcggcacgacgtgcgaagcgtggtaagaaagaagcggccccaggcgctatgaccgccgcagaactgcgcaaggcatatgaaggtttagacgcaatgcgccagcacatcaaggctatagagtccgcggtattcaaggcggttatggctggcgaaggcgaatcgctgggcctcaaaatggttgccggtaaggaagggatccgcaagtgggcggacgaaagcgaagtgattgaaatcttcacgaaggcccggatcaagcgcgatgttatgtacaaagaaacattactcagccctactgatgccgagaaggtactgaaggacgagaagccgaaagtgtgggcaaagttgtgtgataaaataacgcgcgcaccagctaaaccggtattagcacccatcgacgacccgcgccctgcgtggtctgtagctactgacgaggacttaagcaatgaataaagtattcgcaatattattgatgtttgttatcggcgcgctgggctttatcctgcattgtgtgcatggcgtgttaatggtggcgtggatgattcgccatccgacccgctggcttgacgacggatatagtgacgctgccgtcgactgggtggagaagaacatcgaccgaccgccgttaagctgggtagagaacgctaccgactacgttaccagaaatctttttaataaaagtgcttgaccgcttaggcgcaaccaagtagattagcaaccaagccgaacggggtggctcataataaccccgatacatgtgaaaatgaggaattggaaaatggctaaagtcaacctgaaaaatgtgcgcgtatgtttccttaaaatttgggaacgtgatacccctaaacaggatggacaaaaaccggcataccgtgcagtgattctccttgataaagaagatccgcaggtggacaaagtggaagcggcagcgcgcgcagtgctcaccgacaagctgaaatccgagaagaatgctgataagtggatggaccgccactacgcccaggattctaaggaatgcgcagttcgcgacggtgacgagcgcgacgaagtaaccgaagaattcgaaggcatgttgtacatcaacgccaaatcgttcaaacagccgatcattcaaacgtcactcggcgagaagcagacggaacaaggtctgaccgtagaaggcgacgagatcgaaggccaggagatctactccggttgttattgcaatgtgtccctggatatttgggcgtggaacaataccaacggcaagggtctcggggctggcttgctgggtctgcgattccgtgaagacggcgaagccttcggaggtggcgggtcttcttgctccgatgaagacctggacaacgacgacgaagacgaagcaccgcgcaagtccaaaaagtcaaaacgtcgtgatgacgatgatgaagatgacaagccgcgcaagtccaagaaatccaagcgccgcgatgacgacgatgaggaagatgaaaaacctcgcaaacgccgcaagtcccgcgatgacgaagatgaggacgaagacgacgaagacgaagcaccacgtaaacgtcgccgccgttaagggcaaagcccactattcaagcccgcttaatgcgggctttttaacgggacaacgaaaaatgcatattaaagccagcgaagtaaaagtcggaatgcaagtatggtccaagctactgggggaatatttcacagttgccgagattcgcaacaatggagaagagatcgccctgtccgacggcatcttctccatgatcggcagcgctgacgccgtagtgaggataaagcaatgaaagacttcgaacgtctgtttctcgacacagagacatttagcggggtggacctgaagaaagttggggcgtacgcctacgcagagcacccaaccaccgagattatgatttgcacatacgccatcgacgagggccgcgtgcagacatgggattgcactgaatcccccacaatgccgcgtgaactgcgcaaggcgctccgccatgtttcccgcaagaaagcaaaaatagtgatggctaacggcctcctgtttgaccgcctggttattcgcgagaagtggggtattgacctgccggtaagccagatcgaagacaccatgattatggcctttcgccacgcgctgcccggtagtctcgacatgcaatgccaggtgctgggcgttgacgcagaacacgcgaaggataaggctggcaaggcgctgatcaaacgcttctgtaagccaacccctaagacttacaaaatccgccgctacactcgcgagactcaccctgaagaatgggccaaatttctgcgatatgccgcgctggatattatcgcgatgcgtgaggtctactggcgcataccggactggggtaatactccgaaggaagatgaaatcctgcttatcgaccagttgatcaacgaccgcggcttctatgtggacgttgacctggcgaacgccgcgatcaaagcggtgcaggcgcataaggaagaattgaaggaggaagcctgggagcgatttggcggtaaactgacaggcaatgacttcctgccaatcctgcgtgatatcgccccggcgttcacaatccacaacgcgcagaaatccacacttaacgacctgcttgaagacccggacttccccgacgaaggcaaagcgcttatcgaaatgcgcctcggtgcgtcatcaacggcatcgactaagtacaatccgctagttaacggcttatccgcagatggtcgccgccgtgggtgtcttcagtatggcggcgcaaagcgcacgctgcgctgggcgggtaaaggcttccagcctcaaaacctggcacgcggcgagtatagcgacgatcacgaagggaagattaagcgccgcgaaggcgagagcgacgttgctttttgggtccggtcgcacatgctcaccaacggcatcaattccctgttacgcgggaccgcgcactgggcgtatgacatatctaagctaacagcctctaccgttcgcgggtgcattatcccggctaagggcaagaagtttgtcgtagcggactactccaacgtggaagggcgtggacttgcctggatcgctggcgagaaaaccgcgctaatggtgtttaaggccggtcgtgatatctattgtgagactgccggtaagatgttcggcctggacccggactacattaaagctaaccgcaaggacttacgccagatcggtaaggcgtgcgaattggggctgggctatggtggcggcgtcgcggcgttcttgcagttcgctaaaaacctgggcctcgacctttacgcgatggcggacgtcatgaagggcacattccccgatcacatttgggcagcggctaaacggggttatgagtacgcccgtattaacgaagcgaaacgcccaccgaagcccggcaagaaagacgagcgcccaacatacatactgcctaaaaacgtttggctgacgtgcgacgcgatcaaacgtatgtggcgtgaggctcacccgaagacggtagccttttgggccgagcttgaggacgcggtgttgtgtgcaatccgcaatccgggcaaagcatactgggcgggcgcgaacgttcgcccggacggtagaaaagcgctcaagattgtccgtacgaaggcgaagcacgacccaacctttgacgaggagcgcgacgacccgaacgccgcggggtggtggttgaaaattgagttgccgtcggggcgcatcatgagctacccaggcatcgcgctgtctgtcactaccgagattgacgaggacaccggcaagaaacgcaccagcacacgcatcaaataccagggcgagaatcagacgacgcgccagtggggtttccagtacacctacggcggcaaattgacggagaacatcgtacaggcgttgtgccgcgatattctcgcatggtccatgccaggcgttgaagctgcggggtatgagatcgtcctgtcagtacacgacgaattgatcacagaagtgccggacaccgacgactacacgaccgaggagctttgcgcgctgatgtgcgacctgcctatttgggcgaaaggtttcccacttgccgcagagggcgattgcatgtacagatacaggaagtaagattatgaaagcagaaatgagcattatgcgcgctggcgcgactgacaatgacgagattcgaatcgtccttagactggaacgtggcaagaccataacggcgcttgtcacgcctgaaaacctggcgctggcgctaaccggtcgatcggatataccggtagaccttcgtctgcgtaacgtggaattacaaaccaaatgacaccagaaggcaagattcaaagtcaccttatgaagctggtgaaagccgtcggcggattctgccgtaaagtggcatgggaggggcgcgcaggtgcgcctgacctgattatcatcatcaacggcaaaatagtgttcgtcgaagtgaagcaacccggcggcaaaccgaagccgcaccaggtacgtgaacatgagcgaatggcccgccgcggtgctgacgttcgcgttatcgacaacatatccgactgcgatttattggttgctgaattggtcgcatagcggtatagtgtgccggttatccatatcgaggattttagagatgattgaagaaaaacgttgtagtaattgcggctgtgtaaagccgctatcccagttccacaaatacaccggtaagactgcgcgcagtccagacgggtatcgggcagagtgcaaatcgtgccgcaataagaaagagcgcgaacggcagcgccgctaccgtgcagaacaaaaataattaatacggcgggcttgtcccgccatttttgggagacatgacgatgaaagaacactaccgactcaccaagctgggcgaatgtaaaccgggcgatcgcgtatggtttatcgcgggcatgaatgatccgctgccgttgacggtgtgctggcaaaaatttaagagcttccgggctaccggtgtgcacatcggacacgccaccaactacgacgccacaaaaaggaactggaacagtgaaaccgaagtctggaaaaaggcggaataaagatatggcacgtttccgacgtcgcgaatatcagaagttgataaccgcgttcatcctcaagcataagcgctgcaatatttgggcgacaatggggtcgggtaaaaccggcgcgaccatgtgggcgctgaataaaatgttccagactggcatcctgtccaaccaggatgaccgcgtactggtgctggccccgctgcgcgttgcgtccggcacatggcccccggaacaggagaaatggcgcttcccagccttgctggtagtagacggcactgggccagagaaggaccgcatcgctgcgcttgagagcgacgctaacgtggtttgtattaactatgatgtagttgagtggctggtcgactattacggcgatgcgtggccctttacggtcgttgttgccgatgaatcgactaagctgaaaggctatcgtagcaagcaggggagcaagcgcgcccgcgcactggcagcgattgcacataaacacgtcaagcgctggattaaccttaccggcacacccgcaccaaacggactgaaagacctatgggggcaaacgtggttcatcgacggcggcgaacgcctcggcagtagctataaggcatttaccgaccgctggttcattagcaagcctgttaagcctggcagcttcactatgcagcacgctccgctaaagaactccgagaaagagatacaacaacgtctgtcagatgtatccctcaccgttgacgcggcggaatacttcgggtgcgacaagccaatctatacgccggttgttgtggacctgccgaagaaagcgcgtaagatttatgaccagtttgaaagcgagctatttgcagaactggaaagcggaacagtggaagcggcgaacgcggcgtcgaagacaattaagtgccttcagcttgcttccggcgcggtgtataaggtggacgaagacggcgaacggaccgacgagtgggtgaagattcacgacgcgaagctggacgcgctggaaagtatcgtggaggagttgaacggtgcgccgttgctcgttgcgtatcagtataagcatgacctggcacgtcttaagaagaaatttccgcacggcgttgcgttgggtaaaggaaagcagggcaataaggatatggaagcatggaacaggggcgagatccccatcatgtttgcacacccggcatcggcgggccacggccttaacttgcaggacggcggtcatcacctggcaatcttctccgacacctggaactttgaacacttttcgcagatcgttgaacgtatcgggccggttcgccagatgcaagccggacaccctcgaccagtattcgtctacattatccaggctcgcgggacactggacgaattggtcgccgagcgtcgcgacagtaagcgagacattcaggacgacttgatggaatacatgaaagctaagaaggcgcgcaaatgactattgcgaaaatgacaatctggtcactgtttgacggcagcggctttcgtatgccagagaaaaagcctgtattcgttgaaaaagggtactcgaagcagtatagtcgcctcggaggcaaatcagcccgcacaaaattaatccggtcgctcactccgcgcggcttcgcgatagcggttaacgaggaaaatttaaaatgacattcgaagccatcgatttttcggttgcaatgactaaccagttattctcctacgacagcaaaaccggcgtcattcgtctgaagtccaccggctgcaaaattggcaacctcaataccgccgatggcggaacacgtatcgaatacaacggcaagacgctgtctggcgcacgcgtggcgtggattattgagacgggcaatacaatccctccaggcttcgcagttgtgtgccgccagcgcactccagggcactacggcaaccgcataagcaacctttatctggtagacgtcgcacgcgacccgaacttttatgcgtaaattggttgcataatcatattggttgcattatcttaagggtgttccgaagggaacgcccttttttttaatatgaggatttgacgatgaaacgattctttttagattacgacggtgatttgcggttatgggtgtgcatggtgctgttcttattcttttgtctcctgctgccgatttcctgcacgtataacctcgataaatatgaatgccgtattgtctacgcagaactaacaggtcgtaacacccagtggcgctatggcacttgctgggttgaaatggatggcaaatttataccacgcaaagaaattcgcatgacggagattaaataatgaaaattttacaagaagagaaagcgtattgggtagcacagtgtcttgaagcccgcgagaaagcggaaggagctaccgcgctggcaaatacctacctggctagctatgaagaagaagagaaggtccgaaaggaattagaggaacgcttcgaactgctgggcgaactgattaccattatgcagcgcaccggatacacaacatccgtatcgctcacccggctaactgccgatggtctgcgtgagcattgcaaacgtgcagaagaatacgtccgaccgaaaggacgcacaacgaagatcgaccgtaaagacttggtgcttatcgcgtggcgagcaaacggcagctactattccgatagccgaccgctcagtagggcggagctatcccgagtccaacgcgtgctatccagtggcaagaaaaccgccctgtatgcgatagatcccgactatgacggagaatgagcaaaaagatagctggcgcacgccgccagctttatttaaaccgcttcgtcggaaataccgattccgttacgatatggcggcaagcgacgccaatcatctgctaccgcgttacttcacggcggaacacagcgcgcttgatgtggactggtccgagttgaaagggtggaagtggtgcaatccgccgtattccgatccgctgccgtgggtagagtgcgcagcgcacggacgccggacggtcatgctactgaatcaggacacgtcgacgaagtgggcgaagctggccaggaagactgcaaacctgataattcttctggactggcggattagattcattcacgccgtcaccggcgaggtcgggccgagcaataacaagtgccagcaattgataatctttgacgaagcgctaccgaccggcagcgcaaaaattgaaataatgagcgaaggagaactccttgaatatcttaatcgttgaccgcagcctcgcggtcgtagaccaaatgcaaaaagacttctgcatcgatccacgccgcgatcgtgtgcatcgcgtgttgcggcctgaacacctcctgggcatggaccttaccggctggcttgtcataacccgacgttgccatttcgtgtgtaactccttcaccgcgcgcagcgcccgacagacccttattgagagcttaaaatgaaactactgatttgtgatcttgatggcgttattaatggttcgagtgatgcacgcgccgacctggttccgggtataaaaaccaaatcaacattttgggcgaagtggcacaaagcgcacgtacgcgaagacctgaacatggatatgctgccgctgctgcgcatgtacaaagagcaaggcttcgagatagcgtatctgactaaccggcagcgcgaatgctgggagacaaccgccgagcaactggaggtcttccccgcagggcggttgtttatgcgccacatgctggacgacacccctccgcctgagtttaaggcgtgcgccgtgttcaagatggtctgctatgcagacgtgtcggaactggtcatcattgaagattgcgagaagaacatcgcggcaattcgtcgggcgtgcagcgatctggtgccgaaaatttacgcaataaatgttgcaaaatttacttgcaaccaataggttggttgcactatagttaacgcgtcggggcaatatggccccgcgctaataaggaccacataatgaaagcattcgaatactgcaaaaacgccgccaccactatggagcagcgcggaaaagaaaacggctatgacaacgcgaaagcagaacgcagcgctaaacaggtcgccgccgtgtttaacgcgcttaccgggcgcgaccttaccgagcaagaagcctggaccttcctgatctgcctgaagctggtgcgccagcaccgtaagcaccaggaagacaatatcgtcgacctggtagcgtatgcggccttgctgggtgagtcttacatgaccgtgcatgatgagattcaggtcgatacaacggcagcgcaatacgacagccttaaaggttggtccatcgccaccgctggggcgtggcatccttcggcatctgctggcaagactgtcaaagccgctaatttcggcgtcgtatcccaggacgtccagcctatggtcgtgctcaccggcgaagatgggtccaaaatccttatgacgccggaagacttccgcaacatggaaaaaacactggtacgtagcgcactgaaataattctaatcgcgggcttcggcccgcatcaatgaggaccacacgatgtacggcgaatatgaaatatccggtaaacaattccacctggcggcaatgatagcaagcatcgagtttgaccaatggcgcttaaagtccgacgcgtgcaagcaaagccgactggtcggtgtgctgggcgaaatgtttgcgggcatgtaccttgaagggcaagcaggcgggcgcagttgtatcccgcaaggcttgctcatgcgtaccggcttgttcagcgccaataccatcgaccgcggcgatatcatcatggtcggtaagcgcaaggttaaatccggcaccgacttccgcgagcatgtgatcgatgccgtctggacctacgaggttaaagccaccagcggcattcgccgcggactggttgaggcacgttgcgctcgcgagtatcttgcccgtcgagttgctggtgttatcctggtgagcgtagatttcggacaacataacgcgcacggcgtgattgaagatatcgcggaaccatacgtcatcgttaatgactggcccttagtggaagttgagggcaaggaatattacgaaagcccgctagtacggcgcaaaatggactgggaaaactcaaactagaaaaaggggccgcatggccccttctatttatttcttcaacgccgcgatctcggccttcaaatcctccacctgcttattgagatattgaacacaccccatcaagtccattacgatcgggttaacgtcgatggatgggcggtccgtcatcttctccccgatcttgttgccgtcttcgtcgagaatatcctcgatcgggaactcgtggtgcttaacgtactgcggcgcaattaactccgcttcttcggcgataataccgaagcgctggcgggcctgctcatcatccttatacacgaagttaacaaggcgctggctgttaatgcggtccatagcttcgcttgcgtccgcatcggctatatctttcttatactcgcggccggatgtgccttgcagcgcgatagtccccgatgcggtagtcgggaagttaagcataatttcgccggtacggttcccatccttacgtcgcataaacaggcgaaaatatcgagtgccgctcttttctagtgccggttcgaagaacgtcctaccgcctacgacgtcgttcggcacggtttcgcctacggtgtagtacggttcgaatgcaaattgcaggtaagacccgcggcttactgccaggctaccaacgacatctgaccctgaactgttcaccgtaaacttgcccggcaaggtcatctcgcctttggtgttaaagtcgatgcctgaactctgcgccgtctccaggttagtgatcgccaggcgggcgtaagtctcaccgtcgatattcgcacggacgcgcagctttgcttccgagtgtaaagaagtgccaacacgatattcagacacaatgcttccgccgtctgccgtagtgcccgctggcggtttagtggcgtcgccgttgattaccgaccacgacgtattagcggcggcgaatccgcctgacgctcgaataacccacacgcccatgaagttattggggcgcaactccgatacggtccggccatagatcgcgttgaccttcgaggcgtccatgttaatgatgccgtaggagactgcgccgttaccaacaggtaggttgcctggcgaccgatattgcgaagccgctccaccagccccgtggaacgcgccactttcatggttgataatacttgcggccccgccgccgtgtaattcgacgcggcctgtgatgttaggtgctcctgattcgtagatatacccatcgttgccactttgcccgccgtcgcccctgccgaacaagccgaatatggacccaggctgaacgccgttacggtccggcactcggaaggtagttgtgccgtcacccgtagaatacttgccgcgctgatttgggttagccagccaggtatcgtcactaattggcgacagcatttgcgcatacgcccacaactcaggccaatcagcgcggttaagaagttgcccgtcggatacgacttcataaggctggatatatgcgcggctgtcccgtaaatggaaatcacctacgccatagttcatgacgccgttcattgtagggccaaccgtgcccacgttgataaggttctgcacccagcgctttgtcgcggcgtcgtagtcacctacagggtcgcccgccaatggcgttgccccgtctggtcgaacgttaagccaggcttgcggtttgtcggtgagtcctgccaggttgccggatttggttagcaggttatccgcgttaacgctttgcgcccactcctcggcctgatcgcggaatccctgcgctgcggatttcgatgcttcggcttgcgctgcgaggtcgcgcatctcaacggggtctacgttcttaagcaattccgacagatatccccatgacatgccctgcataacctgcccgttaggtaacgtcactgtgatttcttcagcgtcgccgaagattgcacgccagttgttttcatctgcaatcatcaagcgcaatgctttttgcgcctgtacggtaacgcccatcgttgccagtgacatggtgtcgcgcttaacaccatcccaagcaaggccggttgccgttgggccgtcgaacggcaacaccagcgtaagcgccgtgttactttcgattgatgcgatcgccactgtgtaaggcacttgtcctaccaccagcgttaagaagtcgccagctttaaacgcggtaaacgttgtgccgactcctactaccgccgtgctattgttcgttacggatagcgtacccgctgccatagctaaatcctcgtaattggttgcaatcctggctgagcggtgtaatactaaaactcaaccaaatataggggatgataccatgaaaactttaattatgatttgtgcggttcttttgtccggttgcgccgacatgcccgctaaagtctgcgacgccacataccagaatagcggcatggattatgtggtccctgtgtatggtgttgcggacttctccgggcataaaatgctaagggcgggttatccgtttagcttccagtacgtgtcggtagaccatttcaaaaacaccacctgcgaataatccccgaaaggggattttcttcaatcataattggccgtgttaatcgccataatcgcgttgccgttgttagtataccccaccacaccccccgtggcgttccccgacgacgctgccgatatacgcgttcgcgacccatcaaatctggcccccgtgtacgccgttaccgatattacttgcggctggccctgcacaaaaaaccggatcagcgtagaccccaatatgcccggagcgacggcgtagctgccatttagcgtctggtcaatgttaatccccccgttagcgcctggcgatccgacggtaactaaatcgcttagtacgcgactctcattagtaagcactagcttccccgtcttatcccaaatagcgaagccccaccgcggaagggtctgtgggaatatggcaaagatgtaagccgtcatcgtgaagccttgcccgaatggattgctggcgctcaccttcaccacattaccaacgcgagaagaccctacgacggtcggccgggcggtgtgcgtagttttcacaaacgctattgcagggtagtcaccacccaaattaatatcggcagccgccgactgcgcagtgccgttagccgaagacccaacaaccacacggcggaatagacaaaacggcgtcgattctggtgtgataaacgggttgccgtttggtaagtcaatcaacgcgccgtaattagccattatgctcgctccacaaaaacaataacgtcacattcagatgcggagtaaaccccgccacctaccgcacttgccgcggaaaccgtgatagtgttcccgctggcggttattctgcggcctggcccgaccgcgcctttatccagtgcgaccacgtatccgaccttcatccccgccggtacagggaatgaccatgcgcctgatttttgtccttccgcaagatgaatccttccgatcacgcttaccggtttaatgccgtagttgtttgggcgtccttgcgcgtcccacgttgcgataccgaatgccataaataacctcgttaaaaaggggccgaagcccctatactaccagctaccagtaagctcaccaatctgcacgcggagaacgccgtttccgtccttcacgctgattcttgtgttcgtctgtttcatcccgccgccgctaccggtgcccaggttgataaacgttccatctttccctaagcgccagccgcgcgtgctgccgtcgtagttattcgattgcagcgtgtctgttatctgcgcgaagttgatggacgcgttcttgatgcgtgccgtgtcgatatacaccgcgccaccgtccacaataaacgcagacgacagcgtcccattggacggatgcatgatgtagaactggtccgccttgaacgcaatacgcgatttaacctcgttgccagacgtcacaacggaaagctgcatacccgcatcataataagtcctgttatatgtcacgccagccttaaggctatacgtggcgctaccaccagagtggttaaacgaggacgtcatcttctgctcgatagcggcggactgctgaccgaactgtgtagcgacctgggtcttatattccgccagcgctcccgccacgtctgcggttgccgtttgtacctgctggatggcggcttcctgttccccgaacttagcggcaacagtttgctggtactgggcgaacgcttgttcctgtgtgctctgcgcggtctgcaacgtgtggatcgcagcttccgcgtcatcaagtcgcgtgccgatcaacgtctccagttgagcgaccgccttgtgggcgtccgccgccacgttatacgcgaccgagatttccgcataaatacccttgtactcggcgcgggcgttgaacaattgctgcgcgtcggtgagcatcgcctcgtaaataccctgcgggatcgtgttgattgcttcctggaagcgtttaccatcctcggaagtcaagaactcgtcatcaagccccttcatgtactcgtcaactttgtcactcacctgcccttcaaacggggccgaccagtccgacaggttgccgattttatccgctacacgggcgcgcaactgctggtaaattccgaactccagcgatgtttgcgcatactccgcccccggatatgggacgttggtaaggaatttccattcagtctcaccggtcttgcgcacttcaagctcggtgtacgagatatcagtagcggcgttgttgtggttccacttccacaagatctggtgaaggcccgaaatagcgttggtgatgattggtgcgttaagcccaccgagacgaccttccaccggcgtgatggcggacgacacccacggagatgaaatctcgcccataccgatcgcgcggacgcgtgcctggtagttaccggagaacacgttagggatgtgcgccccattcgacgccgtgcgtgggatattcacccagtcgttaccccactggatttccatattctgaaggctggtacgcctccactggatttcatacaccacggcatccttcaccggagggaatacaatatccacgttggtgattagctgcccttgcgatgaaatctgcgacggggtgatggtcacggattccggccccttcattaccccgtcaggcacttgcgtaaagatacccggatcaaggcgcgcgccattatcaacggcatcatacttgctatcgttgtactcaatcccgcgcaccgagaaagtgctcgtagagtcgtcatactccaggtcggtgatgcggaatttctgcaactggatatcgtcgccatcaacgcaaaacggctggtcaggaatagggttggcgtccagtgcggtttttagcgttaccttgttgccgttgacgctggcgatctcgcgagtctccacattaccgctatcggtgcgtaccaggaacttatcgccagggcggaatgtgatttcgctgtccgtgttcagcacggtacgagttccggggtccgacaacagtcgaccgccgcgcgtctcaaaaccgccagaaatgtttgtatccgcgatcgcgactacgctaccgggaataaagaataacccttccatgccaactttaaagctaacttgctggtcaagctggttggaaattagcgcccagtgcccgcgacgctgcgcttcagattcacgcgtacagccgatcgccgtaatatcgagacggttaatcttatggcggcgtaccagttcgacacgttgccccgttgcgatagcatcttcatagtggttcttcgggttgccgtatgctactgcgaacgtggagtaccgagttttctggctaccggacgcgtagtcgaagcgcccatcaataaccgaggcgttggtgatagtgtgcgacactgctgcgaccggttggtcactgacgatattcaacatctggttgccccaccaggtcattccggcgaagatggcggctaaatccttaagcacggtccaggcatccgtctgtgactgaatgtacatatcattcttaaagcggatttctcggccaccgttgccgtcgctgaccaactgatcgcagcgctgcgcaatctggtagagcgcgtatcggtttagcatttgcggtttgatacgccgaccgaggccgaagcgctcagtaatacaaatatcgtaccagtgccacgcagggttatccgtccatgcgcgtttaaacgtgccgtcccagtccccggaataggtatgattgatcgggtcgtagttgttcggtattagaactttgcgacctttgcacttaatggacacgcgagggatgttctggaacgctttggcgtcgaactccacaaacaacagcgcggttagcgggtaacgcaggcgggcgtcaataatctcagtgatggactgcacccggatatcattaaccactttcgccgatgtggagtctgccgttatgcggtgcacctccacgcgccagccggtgttaacgttcggaggtaattcgatgcggtggtcgcgctcatatagcgacattgttttaccaacggcggcgaatctgaactcacgcgggtcggcgttatccgtatacacaactatcttatagtcgatgcgcccgcccaccaggtcgccattatcttcgttagtgtacaaggctggaatgccgattcgaatgcgcacggcgtcaagactggtgtcattaatctggcgcacccacggcgtgccgttttccagttttacgcctacggattgctcactttccaccgctgaaaatccgtggatcacgtcctggtgctgtgtgcctgggcggaactccacgcgcgcgccggggaagttttccgacaggtcggcgttctggatcggagtgccgtccagatatacacgctgccgtaattcgctgtcgctggtaatactttcgaattccccttcccctagcgcaagcaagatgcggattttagccagggaatgcaggctatccggcgtttcctgcggggtgtgctgtttgccgccgccgcctttatgccctgtgacgtcgtagataatcgtcattcgttcaagtcctcggttactattccggctgaaataatagcgccgccgatctcacgctcgccccataatacaccaagcgccgtgccttgcgctgttgtattcactggcccgccgaacgcgtacgacgctttgttatccacgtcctgccttgtctgcaatcctttcggttgtggcgacagcaattgcataacgccacccagcgccatcgacatcccgaacgaaaacgtcgccgtcccgatagcggcagcggttgcagccgaagccccgaaagcggcagtagcaagtccgcccgtatagaacgacgccactacgatcgcgacacccgccagcaattgtcccaaccctctttttgcgcccgtcataaccggcgcgatggtaactacgcggttgccgtggaactcgcccagctcatcatagccggtcatcgtgtggtcgcctttgcgcaccttgaacatcatattgtccaggtgggccgacattagaaagtcctgtaagccgggtaacttcacgcacaggccggtgataccctcgcccggagtgaagcagtccagcttatgcactttaccgaatcgacgtcctaaaacgccgtataatttaaatgtggtcattgccattctgttatattccccggtaggtctttatgacgtacccatttaaccacattgtcccggaaaaatcctgaccggaagggtatcacgctcgacagactgccgtagatatggtgtaggagttggttgcctggaaggaatatcccggcgtggttaggcactggcgcgctaatctgcatgatgaccatcgcccccggcgtattctcctcgcattccctgaatccagcgccgtaccagttatccatatacagattttcgcctgtctcccaccagttatacggcacgcggaagtctggcaaatttactccctgctttttgtgccagtccatgacgaggccgtaacaatccgtaattccgagaacaaatcggcggcctaccagcggcgggtcttccgggtcaatctcaataaagtcgccatattcgttagtgatggtccacactacgccgctgccgttgcatccgttaacgtcgcccagtgagggggttaactcgcgctgacctgggtgtgagtggactacgcgcacgacgtcgcccatatcctcggcatccatccaggccatatcactaatcgtaaaagcgtctttgcgggagcgcacgccggtcgggtcttcgaatacgttcagacatggtacgaacacttgcttacgacccaccatgacaaccaggccacaggcttcttccggcagacacgccgcgacgtgtgcggcgatatcgcttttaacctttttcgttaacataactaccccttaattaatctggaccccggaaagccgccgaagtccagcaccgccgctttagggtccgcaagcccttgcccaaatcgaagataacagtccgacaagcatccgccgcagcggtccatattcattgcgatgacttcgtttccgcgctcgtcgtaatatttgataccgggcttcgcaaggttccacgtgcagccatccccgctggcgtacttcccatttaacgcccattcgcacatgttcatgatctggcggcgtggaactacttgcccctccatatccgcgggtgaggataatgcgaaggttatttgcttgccaggattgcgcccgacctgtgagtcgatgtaatactcctggacacgtttttgcgtcgggtctggatctgtcccgttatccaggaacttcgcgaacgtatcaatgatctcaaccttcgcgccaagtagctggtcgtggttcagcgacagccgggttattatgccgccaatatcgacgattgttagttgcggttctgccgccgtcgatgtggagaagttaaggccggacaaatcgaagggccaaaattcgaactcctgcccgccgaagaagattgatttaggttttagcttgtcctcgtcaccgcctgcggcggcaatatcctcggcagtgtgcggaataaagcaatagtgaaaatagtgatgacccgcgccgatcgcgccgtcgcctggttccacgtcctgcgcgtcaatgtgaatcaggcgaacgcggcccgatgggtcaaagcgtgtcgcctcacggtataatttattcatcttacgaatccaatagcagtcttaagggtggcggacaccgttgccgtgtagtgcccgttgtctgtgtacgacaagctcgaacgctcgaccacgaataaacctgtttcgccatccggcgcggtgacaacaaacggtttgacgaagtgcccgcgaaggaagttgtaaaccagtttagggttgcaccacttgtcagtagtcagtccgatgaattgcacggggaactgtttcgtttcggcgttcgggccgtccgcgatgttctgaccgtaaccgttaccaaactgcaattcctcggaccggaaagccaactgcacgtctccgccaccttgcaattgcatgtgccagtaatagggccattcgtttgatcgcgggtcgtgcgcttcgattagctcataagctgcaccggcttttgtcggtccggcccagttatccgccagggtgatgacggtgttagagttgaatgccgcaatttttccggtgtagtcgttgccgtcgatgcgggtaaatacgcggaccttcccgatctcgctcaagaacgcggttcccacgcctgtgatggtcttacttcccttagttagtgtgattgtaccttgcgccataaaaaagcccccacgttgtagtgagggccattttatcatcgtttgtaaagtacaccacccggtttcgtcgccttcacgatctcggccttgaccgactcggtgatttgctttccgaacgcctgcgcggtgcgcgggtctggaccgctaacactggtatccgtcttaccggtccccatgttaacgttggtcgttacaatcattcccccgacaccgcctgccgcggcaacgccaagtttaccgtctggcccgcgcttaagcggcatgatggcctcggggccagcctcccccatcaatcctgcgcccttagcgaacgcctggacgccataactgaaaaaggtgggctggcttaccacttgccccgaataggccgcgaggttgccccctgcgtacgctccgccgtccgcattcttagtgaggccggagaaaatagcgccgaacaatccgtttttgccgccgtcaccgccgaaagcgctaacgatggacttgaacgcctgcgaggtagccagctttattaattcgctcagaatggacttaaccatatcttttgcgttcagcttgccagtctcgaaaaactcgttcatcgtgtcctgcatagcgccgaacgtgaattttgtgagtgacgtcatctgcgtatagccgttacccatttcatcaacactatccttaagcccgcggctgaagccatcccatagcgaggcgttagcaccggtctgtgcttcctgcacttcgcgcagcttagacaccgccagatcaatatcggtatcgttagcgcccacccgcttcaggcgatcaattagctgcaattcttcgcgcaggttagccgcttcgcgagtggaaagcgcatatcccgccgcggtggcttttagctcggcgttctggttcttgatgaatgcatcgacctgggcgtgtgctttgatctgcttctctttcgcgtccagcaatttggcttcttcgacgatctgctcgcgtaccgatttaaccgcctcgaacgccgccgtttgctgcttttctgctgccgtgagtgcgcgctccttgctcgcggtgattaactgctcattatcggcaatcagcttgttcagggacgcttgcgcgcgttgcgtgcgggtctgcgtcgatgcgttggcttcgatctgctttccagactcacgaagctgggctaattcgcttcgcgcgacttccagcattttcagcccggcatcgactcgaactgccgccgctttcttcggcgcggggtctttgtaacgctcgttgacctgcttcaccgcctcggctagttctttctcgttaataacaccgcgcttattcagcaaatttaggcgggcgatctcgtcggctcgccgcttcgcgttggttgcgtactccttctcaaacgcggcgcggtcgcgggcggcgcggtttgcctcctcgttcgcctttgctgcttcatccgcggcgctggcgctgtctcgctcggcacggttgcgaagggtgagcgacgctactaccttttcctgggcgaccagttcgctgtaaagcatgttaatacgcgctttctgcgcttcggtcatcaccccaccggcagcgtttaccgccctcatctcggcatagtacgccgtggtcatgcgctgcaaggactcacgcgctttcatctcggactcattcgaggactgcgcgcggcccacatccaggatggcatcccacatagatttagctgccgatgtaactacgttcatcgaccgctcaagcgtacccatgttggactttacctcatcggtcatgctggagaacgacgcagcggctgttttgttagccagagcaaccgcgtccgtttcacgccccatatctacaagcgattgcacctgctggatctgcgcctcggtaacgacatgatacttatccgccagcgcacgcagtccgcccactgggtcgttcgacaattttgagatggattcaaccacgtcagagatcggctgattagacgccttcgcgaagtcattcacaaccttcgccagcgcgccgaagtccgcccccgctttcacacccgccgccgccagcgcctggattgtgtcacgcgtcttgcggaacgacccgcccatgcgctcggcgttctcggatagcaccaggatctggtttgccgttaggccggaaatgttacctgacagcgccagcgtcttgttaagcgctgcgacctggttctctgcgcgggacgtaattgctacgcccacgcctaacgttgccgttaccgcagcaaggccgatcccaactggaccgaggaagccagcaacataacgcagagtgttacccaatccaccgaacgccccagttagctgcggtaactgctgaagcataacgcggtgtaccggcatccccatctcaagcgtaactgcgatatcctgtaactggaatgcggcgttacgcgaggcaaagcccaggtttttagtcgacatgcctaacctgttggcgagtcgctcctgtttcgtcatgccatcggcggcgcgctgcgattcgtttgccagcttttccattccgcccgcggcgtcactcgtcacctttttggatttgccgagggtgtcgtttaatttcttaaccttgttttctgtgttctcggatttctgtgcgaaggagtccagcacagtatttgccgttctgatttgtgcaacatcagcctttagcgtgatgcctgctgcctgatctgccattatgcagtccccttttttatgcagttgccgatggatattgtatcagcgatttcaaaacaaaccttattcagtctcagacgaggggggccattgacccccgtctagtctgaaagactggggtgctgtcccgctgtcccgatcggctgaaaaccgcggcagcactggcggggacggggtgctgtcccgttttgtcccgccccttgtttgtcccgctttctgtcccgcttactttatgcaataaaactgcataggtatgcacatttacagggcgtgacaaaacgggacgtcccgcctgtcccgctttgagtttatgcaatgaaagtgattagatatgcggttttacagaggcgggacaaaacgggacgtcccgcctgtcccgcttcattatgcggggttctgctgcgccatctcatcaagcgcgattcgttccattagcttgatatctttaaacgcgcgctgctcgttttcgataccgtgcatcttaaatagccactccagcacgccgtagtcgatgccgtatgcgccaccaaaaccggtgcgccattgcgtggagcaatctgtgaagactgcgactatcttcgcgttgtcaggccatagcgcaacaggcggacaaacatcttcaggggccgcaccccataaactcgcggctaaatcttcggagggtggcggcgggccataaaagcgtcgcgccgcctcaattagtttttttcacgcaatcccatcagttcaagatagtacgacgtgtggaacaccccgaacgcgcgtgggtagttgaccaccaggcggcggacgttctccgcgttaaattcgtccggcagattccagccttctgcgacgtgcatgatggcctcgaccataacgttaaagccgtccgggtcattgtcgtcatattccgacagctttcgttcggtgtcctgcatggtttgcgaaaattcgtcgatcgggcggtggcggacggtaaacgtcatcttgcccggttcgttctcacctgggcgcgggatctcaatcggcagcttaaaggtcggcttagggtcaagtgtaaagagtggtgctttagccattgtagtattctccaataaaaaaggggccgtgctggccccatattaacactcgctatttaagcgaccaaatcaagacaatgcctcgaccagatccttacggtagataaccatatcagactgcatggtcagagtggattgtactgtttccacgttgtttacttcagcggaaggaatcttctggaaagatacctttgccgggtaaatacggatctcacctttgccgcttgccgctgccgggttagtgaacttaatcacagtggttttctgtgtgtcgtccaggtcttccaggattgggcggatcgggtcttcttcgtcgtgggtgaaggtgtaagtctgtaccaacgggtttttcgtggtgttaagactgattgcggtgttcacctgcaacggctggaaggtagtagtctgctggtcgccacccgacacggcaacgttagtaatgaaagggaagtcgataaagctcgacaccttcaccacttcgcccggagtgcctacgctgaaagcgccggtagggtattttgtgacgtcagaggagtcgaagcgcgccagcgtcacgtcgttctcggctactttacccacgatgaatgcacggttaagcgctcggacccacggggttttagtgaacataacaacgtcgccaacaaccaggccatgcgatgccgcgcaggtaattacgcaaccttgcgtaaggtcagagattgatgcggtggcgttggtagctgccgtaacagcgatgccgctgcctaatacggacccgatctggacgctggacccgttggggagttgataacccataataaagctcctgtttagatatacggtttaatgatacagcacgcgcagaattgcgccaaatcaggcacaacaggaatagggcactgtaaccacgatgcgggcgcgatcaacatcctcaatcaccgaactggtgtatggcgcgtcctgaagctggaacgcagcgccggtaagccttacggcctgccacttgtcagacgtcgcgatggcgtccgccagttcgctcgcatactgtgtgccagtgcctgcaggaaacaccacggcaacctgatacacaccggcatagatacggcccttctgctggaagcccacaaactgggtaggggccggaagcaggtacggttccaggtagacaccgctgccgtttgcgtggtcgccgctcacgttctcccagttaacctttatcgggcgctggttagtgctcaggcttaccgataattcttctactacgctgttaagcgccttgcggattagagtattgctcattatttcaccttcgaattaatttctgccgctacgacgcgaacaatccccgcgggcgcttgtttactccagccatactccagccgctgcgcgtacggcacattgttcgtaaaccagatcgacccgtattcgccagaatcataatgcgccagcacttcacgccctgcggctagtgttgccgttccggccttgtccactcggtcgatagcgcctacagccggacggtcgaacgttacctgccagttaccccggaagcgcccaccggtgtaattcttcgccgcccagccacgctggcggaacgtgacgttgccgtttttagttttaaatgagatgagcacactggcgtgcttcttctgcccgcgcttcagtttgccgccattcttgcggcgctgtgcggcgttcaccttgttcgcgtgtttgcgtgcaagcgcgtaagccttgttgatcttccaccggcgtgggtcgcccaccggggagatctcgatcaggcgtccgagtatttgcataccgtacgcccgcaccgccttatcgttgttctccttcgtcttatccacccacgtagcaatagtggcggcgaatgagtagacttcagccacgttagccccttagctgtagttgaaacagcatggtagtgcccgccggttgcagtgggttagggttgacgacccggtagtcagtgccgttcaggttaaccaggtcgcccacccgcaattgctcaaccgcccgacataaaaacttcacatcaccggcaacgatacgcgttccgtcgatctcgctaggcttgtattcctcgcgaagaccgatgacgtcaaacgacatcggcgggattaccacttcatcgccgtctacgcggtcaaccgaccccggacgcgtaaccgtaacggtcatgccgaattttttaatcagcggattcactttccgctttaatcctgcgtaattaaagcccgccatcttcttcgctctcctgtgccggtggtactggttctggctccggttcttgttccgtcggctgtttagtatttgcagcgataatcgccgcaagtaatgcaggattcatattaccccctgaatacgtcgaaattgcctgcggcgttgccgccagaatcaacccagtgccctaacaagccatcccaccacgggaacgacaccccgctaccaatcgacgccgggtcatactccatcgtgatcgggccgaccgtttcgcggatagtctctttaccatcgccgaccggagaaatatcgatctcgtccgccaccaacatcgccaaccggtaaacagcttgctcaacggcaacgggggttgatgcgaagtctacgatctgcccggcgggcactaccgccacaacttcagtgagcgtgtcccgcaccggcttaccgtctgacgggtaattaatgcggggccatgcgtcgattccggtctggtctgcttgttcgccgatccagttgatgccgttaaggaagtcgttaacgatggtaaggtgtcgcgttgcatcgcctagcgtaatttcaacgcctcgcgcagcggcataatcgacaaaggtttgcgggtcgccatacattgtattcactcctataaaaaaaaggcgggcataagcccgcccctttgggatgtgcgcccgttaagacgcggtagtcgcagtcagcgtaaccagtacgccagcggtttccttgatgtgacgggtaggcactgcctgtgcggcctgggtcttacgacgacctttagtatcgccatcacccacagcgccaacgtcctgcacggttgccggtgcgttgtctacctggccctggtccagttcccagttagcggaagtggtaatatcgtccagtttgaacgagcgcacaccttcgatcggggtacgagcggacgccttcagacggtagcctttaacggccacgttgaagtcgaactcgccctgccaccagcgttcgatgttctcgttaccgcctttctcctgcgccagcatatcgaggccgttggtggtaactgcaaccgcgccagggaccagacccagcatgttaccagcgcccatagcatcggcagcggcatcggagataatgaagcgacggcccaggccatcgcccattacctggagatcgccaattgcgaatacctgttcagcggaagggagcgcctggtacgcaatgaagtttgcccaggtaacgccgtccataaaccaggacttaatcaaagacgcctgatcgccgaacttagaagccgccagcgggaagtctgccagggtcggaaaggtacgaccaccaacgccgtctacgcgcgccggttgggtgtattttgccgctgcgttgctttcgatcgccgctttacccgcaccgatacccgcttttaggtagtgcagcataatcgcttgagtagcctgtgccgcgatctcagccgcaacgctgttaacgttggtttcgatcttagccatcatagccttagtgattgctaccggacccactttcgcggataggttaacggagttggtcagcatacgcgccagcactttagcggttgccggagtgccgacaggggcgtaggcgttacggtcggtaacgaggttggcgatcaatcctacggacattttctcaataacatccttcagcacttcaccagtaccgagaacaacagcgccattggcggccgcgttgaatacgttcaggttgtcggggatcatttgcgtaaccgcggtaacgagtttacgctggaacactgttaaagacatatcgaaatcctttgagttgtgagcattcgcccagtgacgttaatgttaccttagatttacgcgctagcaaaatcgcccgctttcgcgggcggtcttcctactcgtcgcccatcttagcgatgatttcaccagcctgtttcgtaaggtcagtgataccgaagctgtggcccatcgtgattttcgacttcacatcttcgacaacctgcgtcggtttgctaggcgcgccgcctgctggcgtgccagccaggacggacgcaaaatcggcgttattacggaactctttttcaagttcttccatagtcagcgcggacggtttgccatcctgcaagacacgcactttcaagctgccgtcttcgccgtcttccagcgtcaggcggtccattacgtggcgttgcatgatgcccgcattcttaccgaacagcttcgacgccaggtctttggcagcgctgccgatggttagatcgtggatctgcttgcggtaggcttcgatttttcccgatgtgtctgcttcgtgtttcgcaaacttatctttccaggacttgtcgatcgcttcgaggtcgccatttttgcgcgcggcggcttcctctttctctttcgcaaggcgctcagcttcggcgcggcgttcagcttctgctttcttctcgctcaccagcttcgcgttgttgtctttcagacccttgatttccgcctgtacttcttctgcggtcatgaacgttgatttatacccgtcgccatcggcaacaaaaagcgccttcataccttccggcaacgcgtcatattctgctttagtaagtttcatgctatccccctgggattgtggcagagcaggccacccgctcgacttcacgcttctaatattatcagcgataaaaataatcgcaaaattcgcttgcaatccgcgtattggttgcactatattggttgcacaccaacaacgaggacacaaaaatgagactgacaaaagacattaaaaaccagattctggctaacatcctgcgcgaccacgaaatcgcgaccgaagccaaatcaatcatgatggactctcgaaatctggcgtacgccattacgatggactgtatgccggaaggcattcattcgttcgccgagctacgtgagcgcattgcagcaatcggcggtgacccgtcgcagatgtacggcgtctgtgtgtacaccaacaaggcgacgtatagacatgacgccgacagcccatatggtgtaggcagcgtttacgacgccactttcgaaatcaacgcaggcggaaacgtccgtaccgtgtcattgagcggagacggacaccgagtccgagtatatcgcggatacggggagtataaatacatgaataaactgtctcccgatctcggcgatattgtgcctgggtatgaggaaattttgttagcgtcagtgtgcgaagtcgatgacgacgggaaagcgctgccgatatatatatgccacgcggtcgtatagactacccggcggaccatgatttctgtaagcgcctggaccgtaacgacaaggcccgccgtgagttgcgtgctaagtatgacgcgttcaaactaactgttaccggcgtgctggatatgcacaataccgataagaagctgatcaaggcgtggcctgaagtggaacagttcattccttacccgggcaagccgaagtccacggcggtggcgctggacgtgaagacgttaaacgagatttgcggtattccgcgctaataaaaggggccattacggcccccgaattatttgctgcaactccaggacctgcgccctcagcttcgccccgcattccatatttttcacgtcaatcatcaaatcttcgtcggggtccgcggacgggttatcgaacttgcacggcggtcgcagtgccgactccgttagcggcatcaacggcgctttgcttgatccgcacgcgctcagcatcaaaactgcaatcaggacggttaggacgcgtaacatatttaacaacctctttcgtgatagtccggtattctacgtcgcgggcttgttcggcctgcacggagcgctcaataactttagtttgctgccgttgggcatctgcttgcgcttcttgcgccgcctccgccgctacgccagcgcgataggagtcacctagccagaatcctaccaccagaccgataaccagcccaatcgctgcatacttaatcacgccataacccccggtttttaagctgtgcaatagtcatcagttcgccagaatcggtaaacatcttcggcactttcacgccgcgcataatctggtcggcgcgttgcactccatataattcttccaggatatggcgcggctggcgctgcacccatgagaagaaatcagtctgcgcgtctacctgctcactcagcaatctgcctgcgtcagccttcagtgccggacgcttaccactgggccaatcttccatacctttgactttccacgtctccgtcgaacggcagcaataatgcagcttgcccggaccagcgccatattgtgacccagccaccattttcccgccgcgttttcctttggtgtcgggagtaacatcaaccggataaaacaggcgatcgcgtagctggcacatgggagaagtatgcgtgtccaatgtagccaaccattggcgaccttcgagaatatcgtcattagcttttaccattaattcgcgggcggtcgccgcatagtggttgaccgcggacttaacaacgcttgagattgcttgcgcactacgaccgccgagcgcgcgcctcacgtccgcgataatttccatcgttggcttgccctggatgaatccggcgcgcacctgattcccgatctgcgtcctggtccactcggaaagggaatcaggccattgcatcatagtattaccctggaacgggtttttcattgccgtcgctgcaatctgcgcgccggtaacaacgccaactacttcaacagcgggtacggcgacagcgggctggatcgctgccgttagtgtgtccgcgagataatcagcctcggtgtcggcgaactcctgaaggctctccgccagcactttaaactcggcgcgcagttccgttttgacggtcttgtcgagttgcgttaacagtgtggtaagtgccttgttgctcatggactttttgccatcaagtaactcggtcagcttaccaagtaaagtgggccggaacttctcccacatagccagcaccctccgcgcctgatcattgctcaggcgctgggtgaagatgtgacggcgaatcattcgatccgccaaatattgattaactgtcttcgccattgtccgctaccttgtccgggtcttcttcggtagattctaccgcatcaggggacatttgaggcaatggattctgatttcgcaattcgtcttccacctgctcgacggtttgcgagtcgtctatgacgccctgcgccatcatccacttgatgaagtcagccaggcggaccgtaccagtctgcacccccgacatcatcgcggtcataagctgagcatcaaccgtgatttcggtgtagaacttattcagcgtcacacgctggtcggcggtgtcgcccgtgaatagctggacgatttgcagcgcacggttgaaagccttctcaacgttaccggcgataagcgacaggatactgttatcagtctgcgcatcgtaggccgcctcggttgccgtcttaggtgcggtccccttctcgacaagggccgcgccaagtttagccatttgcaattcgcgacgctcacacagcgcaacagacaagttgcgctcctcggcctgaatcagtttagcgtccatgttctggcccaggataacgcccttagtcgcaccgagggcaatgccgcccttcaggttcttgtcagcccatgattgggtcaatcccgtcgcaacgagggtaggttggcccacgatgtgcgcaatctcggcgacgtccgcttcggcgttgtagtgcttaatgttgatggacgcgatatccgccagcggagcggcgtcaggcgttgcgttgttgtccaccgcaccacaccagcaaaacggaagttgtgtaagcgcattaccggaggcatccaccagcggcaccaggtcggtgcgggtgaatccacgcggcaaatccatttgcacctcggacgtgtccgcgttgtagtaccagcggcgggcgtgtgccgcaccattaatcatgcgaagctcggtccagattgttacttcgtggtttgcgaagtcgtccgggtcttcggtgctgatttcgtccgtttccttcagcacaattagcgtatcgacgccgtgggtctgccgccagttgatgatctgttctgccgtgtacaggcgtataagcgggcggtgtgacgccatctcggcggctgtctgcggaactacgttacccagctcatcaaagttagcctggcggtcgtagtccaccataaagcccgcacgtcctgattgcagcacttccgacatagcaccgcgcaggagttgcggcagaggcataccgctgccgtctacgtcgtcaatcaggtcagccatcgccccggaaaggtccagacttaccggtttagcaaaggcaacgcctaacagcgcgttaagtgtgcgggcggtggcgttcaggaatacagcgcgttgcttgtacgccttataccgcgcccgtgctttcgggtcagtattgtcgccactggcgggatgaggcaggtacaatgggccgcacgccttcacggcgcgctcccctgctacgcagtcacggatcattttccactctggcgcgatgcgcgcatagagcgggtgctggttgtcaacgttaacggtcatggtcggtttccttagtagaaatctacggtaggaacaacggcgattggacgaatcacagggaacaggtgcgcaattggataacccgcggcatcgttcatgtggtccacaccggcggttttatccggctcgcctttcttcaggtcgtaaacctgctgttccagacatttcgctagtgtagggcatttatccaggttgacaaaatactggcgcacgcccttcgagttgcacatcatcgtattcatcgcgatcaatcggtctttcacaggcgggttaacgctgtcgtattccacctcgaagcccgcatcttccagttgcgcgatatcggacgacgaagcgttaaccgttttgcgggatttgccgctgctatccgggtacacgacaacacgaccggcagcgcaatgatcggggtagcgctcctcgatcgcttcaatcatagccggggtatcaaacaggtccacgaattcatccacggcgtgaatctcgtcgcggaactccttgttctcggtggtacgctgccgtcttacatacacgaccgccgccattttcgtgacgttaaagtccataccgataatcagcgtgtcttccggttgtacttcttcggtgctggcgttctcctcgcgattaaacatcttgtataccgcgcccgatgtaaggttgacaaacaggccgttcaggtacgcgtcaataaggttagccgggtactgactgcgcagcgtgtcgataaagtctgccggtaaatggtggttgtcggtggtcttcgcccggatcaggcgcttttggctatccttctccacctcgaaaatctggtacatcgcccggtagccttccggggtggacactatgacgaactggcgtacaaagcctgcacgcagacgaccgagcaatttgtgatacgccgccagcgcaacgtcttgcttcgtggtatcgaattcatcggcaacaatccacgcggcgttaaccccgataaggcgggtgtagttctccatcgactcacagataacgcgggtccatttgcctttcacaagcacgttatagatcttgtcctgcttattgaacttccaccggaagcctgcctcgtcgaatgccttctccagttccggatacatgatcttaaccaggaggggaatagtcggttctgtaacgatgccgtcatgaccggggttcagggttaaaagctggatgaccttacgcgcagcgacccacgactttccaccgccgaagccggaacacaggccgaggattttagtctttgtgtcgcgcagtagttcaacctggtgcggcaagcaatcaggctgatacaggcggacggcctgcgcaacgcgtgtcggtcgcggcggtcgatttcgctttgcgatcgcccgttcgagggcgcggtgttctgccgcatagttacgcattattcaccctggcctttgccggaaggttcgacaactacgtcgccgttatcatcttcgtcgtcatccagcggtacatcgtcgcggacgccgtggttcgctttaagcaggaatgtagcgaagcctgccgcgatggtcacaccaccggcttccatcaggaaagttttctgcaactccatagcgtccgccatcgcctcggcgaactcctcatgcgcacgcgcccagcgatacaggcaagctacgcccacgccgatttccgcggcaaatcgaccgaaggttggcattttgttgcgagggattacttgcgcagcgcctttatcggagtagtttacctgccaggcgtcggcgtcggcaaaatagcggcgaagctggtcacagtaaacggatcggtagtccgtagggcgtccgcatttaccgcctttgcggcgctttccgtactcgatttcaggtccgagattggtgtgctcggtttgctctcctggtttacggcgcggggtaactgcgactcgtccgtccagtttggcgcgacggcccttaactttaatttctgccatgatataagcccttttgttcatatgcgccgaccatcggcaacataggagacggccctgccatctaaggggattataacaggcacaaaaaagcccaccaaatcggcaggctgggaggcttatgggttgccgttacttcaacatttccgggctaatggttaagcgcgctacttcgccgtagttggcgctataggtgatgacgtttgcgctgcgaccggacatccaaccgccacgactggcgtaggcgtctttcgctgcgagcgtccggtgctgttcaacaatcatgttgcgggattctacaatcttctggtggtgcaagtggcctacgtgcgcgtagctgtactcactggatccgaaagcctgtctgaatttagaaatcataacctgctcgatagcatcgaatcgcgctttgtgcccgtggtggaagaatagcgtggtcttaccgtgctgcaccattttgtagacgtccggggacgtatccacatcgacgcgcggctcgttctcgtacagagtattgaacatctcagccagccaaatcatacccgactcgtcatgatttccctggacgattagcagtttgactttgtggtgtttttgcagcgccagttcgacgacgttgcgcaccatgcgaatcatgtatcggaccagtttctggtatcgggtgtcggcgtccagtatgtgaccacttgccggagtgacagcatcgaggctatcaaagtgcgccatatcaccgaggatattaattacggcagtgcctgcgtccggggcgcgtgcgaaggcttcgacaaaccagcggtagaacaggtcttcggcgatcgccatatcccagtcttcgccagtctcctcgccccatgccaacatgcccaggtggaagtctgacacggtgtacaggttgagcaagtcgagcgcctggatcggtactggcggggcttttactggcgctgccggtgtgatttcgctgttcataccctcgacaacagcgcgcatggcttcgagttggcgctctttgtcctgctcagtgatgacccacgacatgacctcttcgccattgccgcgcaccagggccgatacgcgcttaaccccaaacccatcggcaacgcgcttgcgtattacggcatcgttgccgtgtccaatgccttttttcgacaggcgggctttccgcatataaacattgcgtagggcaatcccgtatttcttcgcaatatctttaaccgtagtccctgcctgaatttctgcgatcaattgctcatcggtaattttagtttgcgggtgcatatttaattaattcctgattagtggaccgtggacaatataccacggcccacactgcggtgcgctatgagttgtcttgctgtttaaattccgccatcacgcgacggaactcacccataacttttccttgctctttctttgtcaggaacgaaagaccccggaagaatgacgcctccatttgggaggcccgcggtcgttccgccatagggcgggaatcgcgttgcggtttaaatgccataagtcacctcacaaattaccattccaataaatgccgcggcggaccagattgccaatacccaaatatcattacgtgccatagtgtaatactcctcttgttgattggtcgcagtatggcgcctatgttggttgcaagtcaagcaataaaaagcccggaattaaccgggcttggcagtttacacttctggatcttccggcggtggcggactcggcagcttcgcgtcaaatacgccagcatgactgatagtgtccgcgataatggcgcgagcgcctgggtcttcggttttagccagcgcggcgagcgcgtccgcattatgatcaagaatactttttaacatactgtgtctcctcgtattatgcggcgtttcgcccgattttctcggcaacgtcccactgcttaccatcaaatagtgcctgcctgccgattgcacgacggacaagccccttgagcactgccccgccttgcttgcggaattgtggcagcgtagcacggacctttgcccagtcacccaggcggatcgcatcgtcgaagtctccggcgacgtcgtccggcatgatcggaccaggaccggcattgataaccaggtccaccagcgcgtcgaattgcgcctggttgatgctcgggtgtgcgtacttgtttacccagttctcggcatacgccacgtcgcgcttgagtagctccagtgcttccgcacgggtaatgctccgcggcggattagtgccggtgtgaccatagccccaggtatacaggccgcgggcctgctctttcttagtcgcgaaatacggcactgggctgaattgctcccatgctgccgtaaatctcagaccgttgtcactgaatcgcatgttttaccccattcaaaacagcattacgcagtgtgcgcaatgcaaacagccagattaacgcggtccaggtggtgtcagatacgtctccggtttgcaacagtccgataatgcagaccatcgccgtaagcagatataacacccgaccgaagaagccatcctggacggacggcgcatacacgttaaacagggacgaagcccctatgataacaaacaacaggacggagataatcattttgcgccacccggaagtcggaacgactcaatagtctccctgatccgggcggctattggcatccagaagattgcagttacgaagcccaaaccggcgacagtgcgctcgccagataagccagcccactcggcgatagctggcgcaccaaatatggcacacaggaagccaactacgacatataaaacgaagttcaacggccctttcgttgcctcgccatgaatgcgtgcgcctacgaagccaccagcaagacacgcaagggcgaataaccactcgtttagcttatccataaaaaagtcccagtaagttttagctcactgggactatatcacgcttgcataa

SEQ ID NO: 13 - DNA, 108287 bp, Unknown
  bacteriophage genomic DNA
  misc_feature (65597)..(65597): n is a, c, g, or t
tatccggaaggtcgctggttgcgaacacagcttattgatgcggagtggcctgatatacgtcgtattttaaatgttcaatgcaatgcacatcctgttgatcccggtctttttgagggtttgcataaaattaaaccttttgcagaagatcgtcctcgcgtatatattgaaaacggtctagcgcgtactcattacgatgatgcggaaggtgcaagcttcgtattgcaggacagatcaataacgggagtttacaatattgacatcctgttattactcgaaaatgtggttaagactgcggactttagtttatatccgcaaccttgcgcattctttggggaaaatcttcgcggtgtattaattggagaacgtgtctaatgcggacagatgctattggtttcttttggcaggacttaccgcctgagccaaaagcaaagaaagaaaaagttaaacgtttaccgccggagcgcacttgggagcgcccggattatttgcctaaccttgaggaagcgcggaacttccaatacaacctgtatacacaggatgaacttattcaagcatggattaaccgcgaaccgcttgtatacgatatcgaatgttatccaaactacttcttgatcgcattccgcggagtaaggactaagaaagttgtctatttcgaaatgtatcacggttgtagtttaaattgcttgttacttaactgggtaatgataaacttccttatcgtgagctttaacggcaacgggtacgatatgcccattgctacgcttgcgcttaacggatgctctaatgctcagcttaaagatgcaaccgataagataatcgtggaagactggcgtccttctgatgtgttgaagagttaccgccttaagcgtatgcagaacgttaaccacattgatattatggaagtgctgcctgggtccggtggtttgaaacaatatggcggacgtgtacatactcgccgtatgcaggatttaccgttcaagccaaatacaatgctgacgcaggaccagatgttgattgtacgctggtactgtattaacgaccttgtacagacggaagaatgttttattgcattacaggaacctttacatcttcgtgaaattatgtcgcaagaatacggtgtggatctgcgttcacgttctgatgcgcagattgcagaagacgtgattaaacacgaaattcaagcgttaacgggcgtgcgtccgcagcgtccacaagtttatcctggaactaaatatgcatataacataccggactttattcgttttcaaacacctctgatgaatagtgttttggatattgttcgggactgccgctttgttgttagcgataacggtggcgttagcttgcccccagcgttatcaggcctggagatcaagattgcggacggtgtctaccgtatgggtattggcggtttgcatagctccgaagagtgtgctggtcacggtaaagagccaggtattaagaagcgggacattgacgtaacgtcctattacccttcaattattcttaatcagggcttataccctgagcagttgggaccagcgtttcttcgtgtttataaaagcattgtagaccgtcgtattgcggctaagcactcaggggacaagaacacagccaacacgctgaagatcgttatcaacggatcgtttggtaaattgggttcaatgtggtccgtattgtacgcgccgcaattattgatacaggtaactatcaccggacagctatccctgttaatgcttattgaagcattcgagctgaacggtgttaaagtaatttctgctaacacggatggtattgtggttaagtatcctgaccacatgcagggcttcgttgataacatgatcaagtggtgggagtctgtgacaggctttgaaatggaatccaactactatgacaagctgtacagtgctaacgtcaataactatgttgcagtaaaagaacctgatgaggaaggaaatgttgaaatcaaacgtaaaggctggtttgctaagacgggacttcaaaagaactgtacgggtgaaattatcatggaagctgtatgcgaatgcctggcccacggtacgcctgtttctcgtactatacgcaattgcaacgatattagaaaattcattatcctacgtgcggtgaaaggtggcgcggtatggaatggcgaatttttgggtaaggttgtacgctggtatttaagcaccaatgaagaaactcccgaaataatctatgctaactcgggcaaccgtgtagctggtagcgcgggaggtgtcccaatcatgacgctaccggataaaataccggacgacatagattatgatgcttatatagctaaagcagagaagtatctcgaagacatgggatatgcctaaattctacttgcagacccttcgcgggtctgttttaatatatgcatacaacaagaggagatgcaaaatgagcttagtagacgattacaacaaaggtaaaatcgacgcggtggaacttaaccgtcagcttaataaacaaaatgaagaacgcaaacaaggcaaataccttacaatgattgttgcgcttatcttcactgttattggtggatgtgtttacggctacattgaccacactgttgacgttggctacgaatgtcgcgctaaatatccaattcacgttggtgtaactccacaggaagacattgatgcgcttctggaacttcaagccttatgtcgtaaagggaaagcataatgaaacgtttattactcgtaactttgctgatagcacctggtgtccaagctgtggatttaaaagatgcagcaaagaaactatgccaagaccatcctattaagttacaatgtgaagaccttgtatccagcatgttaactcattcttacgtgatgggacaaacgcagcttggatgtgagttaggtattattgatgcgtgcaaagcagcgcgtaccaataaacattttgaaaagaacgcacgttggctggagcagcgcattagaacccttgatcataggggtacttttgggggctagccgcgtgtaaaaaccttaaaggggtacattagcatggctggtaaagaaaagagcgtagcaagcgatttaggtgtggatgtagtaagtcgcgaaccgtggcaacatggtgacaaaccagtagtttacattcacgtctattactggaataatatgacagcggagcaacaagaagcgttgaaagttttagcggacgttattgttgttccagatgagccaactccggaatcaccggaagcgtaataaataatacccgcgttcgcgcgggtattttaaggagtgaatatggctagagcagcaaaaggttacagacagacttttaagctaattggtggaccgtgggacgggcaaaaggttcagttgtatagcgcagcaactttagaattttccgttaaaagttttgatcctcgtcctgggcgttatgtaccatcaagctatcgtaatactttagaatgggagtttactaaatgaatgaatatgtagttatttattttattattggtgctgtgattgcagcaatgacttatttcttttgttggaataactatgattatgcgctagcctataagaaacgttgggagaagattgtgagtcttctatgcatactcgcttgctggccagtcactattattgcgactacttatgatcaatacatgtaccggagaagacgttgatggaatacctgctagtaattgttgcactgtttcttattattgtggttataatgactggagacagtaacgagaaaggtttcacagcaatgagcagggcgttattacgcgcccttgctgtcgcactggttggaaccagctttgctatggcgtttgggattgtggagatccctagcacctattacggttttgttaaagttcaacaccaacttacttatgctaccgtcgtcggattgggtgctgtaacacttgcaatcctgtcagcttttcataagcgttaaagaaaggggcttttgccccttttctcttcttagaatatacgaaagaaagcaccatatgggtatacgccaaaagtattgaaaacaggcggtgcaaaaccattcacaaaaacaggagttggcgctactggttgaaaagttttgcaattacacgctgcttgagccaattgcccctgaagtatacctgcttgtgttgcaggactgcctagacagcaacggttagtattaccacacattgtagacctccttaaaggtcgctttcgttatcctgcttggaactgagcttttcagcttcaatcatcccaagtaccgcaataactttaacagcaatacgctgagccagactgatttgctgctgggttaattttccggttgacaccacggtcattaatccgcttaagtttccaagcgacttgaaatcgctgaatgcggatttcataatagtaagttgatcatgaccttcatcgactataacatgagcacgaatagaaagtccttcaacaacgttatcaataccttcattcttcgtcatttggttttaccttctgctccggtttctgagggaccgtttgagcggtctttggctgcaacacttcctgatcaatcattggtggccacggactaatatgttcgcgggcttctacaggttgctccggttgcacgccaagaaacttattaataaaatcacctgcaaagtctgtaccatcgctgacgtaaacgtgcatacgatcaagatcagactgactaatggagtttggagcgatcgtgattttaaactggtggaagccgacatacatcacattcacgggtcgttcgatagtgcccggcgtaggcggtatcactcccataatccaacagtaatgaacccttccatcacccataggttcacagccagcattaagccagctaaccttctggtgtgggaacatggtagttgaatcggtagcgtcccgacgtaacgtccaatcaacaccgcccatgttgatggagtttttcggtttcatcccgttgaactgggttacgcccattcctgcgtttacgttttgcatgtcggcttcctattcttacatatctttcattttttgaagagcgcaagtacaagctgcggcaagatcagtcaactctttcatgatccctgcgcggtcgccttctttcttacactccattaattcgcggtattccatttcaacaatggacatcataccgccgggcttgtcgtggtacgccgcccacgtatgcggaggttcttccatccggtcaagaacatttgacatagctgccatatgttcatgatctcgagcataagagtgagcatgtttatattcctctttctcatgctcatggtggtgctcacctacgctaatgcgaggtaaagcaaccttaggcaatttgacccgtggcattcccatcgttgcgaatttaatgtggctcatgatagtacctctgttaaaagcgccccaagcggaggagcgaaaggcgctttagtttaaccacacttcaacgattagcagcagccagtcggaggagttggaggagttggcagtttaaagttaactaactgctcaacctgattgatcttacaagtaagaccagccgtttgtgccaactgagagtttgcaaagcgagcttcctgcaactgagatttcaggtcacagatcagaactgcttgcgcctgtgcgtgctggtcacggatcagcgcacgggtagcttcagcttgacgctcgatgttcaggttggtttcgcagcaacacttctcggctgctaactgggcctggaaagaacgggtaatgttagccgcttcgttgctacacagagccgcgagcacttggctggtgccgccctgaatttgcgtgttcagaccagcgaagccctgaacggaagccagcaggttctgagtgttctgctgagtgatgccgttataggtagaagcagcagagcgctcaacagtcaggttagtaccgttctgcccctgaatggtctgaagagtaccgttgttgatagcctgcagaattgcgttggtgtcaacagaagcttgcacttctaccggaccagcgaagttaccgcgaccaccccaaccaccattgccaccccaaccattaccgatccaggaaccaattaaaccaccgatcgcgccaccgataccagccgcaccagcttcaccaccgaaaccgtcgccaccgagattagtaggtaaaagagtcatgtcagacataggaaaatctccatatatggatttgttaagcggatgtaaccaactggttacgaagtaaagcataccccttaacatgctttttacaatgatccatatgtaaagattttataaattgggattgacagccaataaaaagcgcgcccgaagacgcgctgttgaagttagatgtggttatggtaatggttgctctttattaacaagcgtagcaactaacgtcttaagttcctcaacttcagtttcaagtttactaatacggtctttattatcttgatcctttttcttgagggattgtattgcagctaatgcatccaataacaatgggttagaatccaaagtcattttcccggatgtttcagcactatgcacatattcaggatcaacttcctgggcctgttgagcaatgacacccctacggatttcacgctctggaccatcggacagatagttaaagtatacaaattcaagcttgcttatgttatccaatgcaacatctgtatccatcactccgtgaacacgcttgaaattaatatccgatgtgccagctgcttgaagtgttgtccaaggtttatccgtcttagaagcttgagcgttaccgctatcgttaaaacgaataaacccctgcgagcttgatgtcatccaaaattggaatattcgctgctgagtatacgaagattgaaaaccccctccgttagcgggcgaccaagtatttgccccatcggaatcagtgtaaaaaccacttgaaccatcttccggtttaaaagttccaattagaccaactccgtagttccctttagttactaattgttgccattgtccttctactcctgcttcaaatgtgcggaagaaggatttacctttccttccgcatatctggaaagcatagttgccgctgaatccaacatgtataccaccataaaccacattgttttctggtgtgttaacttgtccagcaatcccatagaatttattgacggtattaatctgaccgttccaatctactccagtagaagatagcaaaccagcgggagcgctgaatgtcccgttgagattgaagttaaagaattgatgcgcagtcccacccgttggatcgcggactataatttgaccagcattttcacttgcgcgaaactcgctgtcatatatcacgtcaccaacacgataacgactataaaaagtagcattggatacagatgttccatctgcaatgacaccgttaccagcagcaatggttccactgaaagacactttaggtgtggttagacttaactcttcgcccacagacattccgttagataaaacaatacgttccccatttccgatataataattaccttctgtcgtggcctggtaaaaaccaacgcggtttaatgaaaaatcaaataaggtgtttatagctacagaatccgttgcagggttagctgtaccccacgcataggtcgtatttttataagtaaagtttgatgttggtactgttacttcacagaatgcagggacacgcaattgaagagggaaaccacgaccttcaacatatattgcaacgtatctttccgcatctttagatgaagaaagaatacatttcatagcaatttcattttttgcatagttgttgaagtaaccataaccgccgtcttttcggtcgctccaaccaccacatctaataaatccgttaaaagtgcaacagttcattgggtcgtcaccagcggcagaacgtgtctttatatctataaaagcaccagaagcatataaagaactgtatgccatatcgatgataactggataatactttccagcttccacgccaggaggagcgttataagttaaccaatcacccccacctacagacggaatttgaagattagtcttagcgtcggatattgttagggcaccagtccctcccctattaataggtaaaggaatgaagttttgagcttccgcgtcataagcgccccaagtcttgttattagaaattgtcatatatgcttgacgagacggagtataaataaccgtttcgttagcactttgataaaaacgatctaactgtagattaatcctggaatttggagcgtctgacaactgcaaagcattaccaataaaatttccattgatttgaaaattaccatcaacgcttagaccagcatatttatttgttgctgtgtctgattgaaggtgtaaggttaaccacgctttattgtcgcctcttatttcagaatatatgcggtagcgacatctttgaactccagagctattatttaaataaccgctcacaatgccggaaggcgcttgtgcggagtctgctactgtaacaagattaaggtttctgaattgaggtgtatcgttagaaccaagtcttaagtttgtacgagcatccgcgtctgtgagcgcccctgtaccaccttgagctattgctagaggtatgaagcgtttattttcattgtcatatgccccccaaactttattattatctatgaggagttttgcattacctaattggtttgtaaaattagtttctgcgtttagctgggtatatctgttgacagtagaatagttaacctgcttccaccatgtaacgccaacgtccttgatccatctatagctatatatagtcccggtcatgtctccaacaaaaacacctataaatccaggggttccatccatagcggaaacaaaaccggctaatacgttttctgaggacgcaatatccggataacctactgtactagaccgtaaaatccgtataaaacccaagaatgatgacgggttgactgtaatatctgcaacatgtcttggtgcagtagtcaaaccaatagaagctttcataccgttagcagtgtttacagcattctgagccgcagtctctgctttaacgcgttcttgctcggatttagttgcagatgtagcagaagcattcttagctgtctcagcttgtgaaactaaatctttaacctgtgcaatgacttccggagttagctcttccggtgcccaggaagttaaatagttattgagcgtaccttctttactgtccgcgtaaatagcaatttcaccagctttataaggctcgctaccttgcggaccgataataaccttgtaatagcctgtttggactgtaatatcatatgttccggttgcgcttgttttaaagatagcttcactaccggacaataccaataagctattccctttcgctaaaagtgcaactgtagcgttgacaattggtttatttaaaccatcaactaaagtaccacgtaaacgagttgccataatatctcccacatttatttgacttactcaacacaacaagtatattagaattgaaccttgacaacaacacaaaggaggcccaatgaaacgcgctttaactatgctggcattaactttatccctcactgcatgtggtaacggtttaaatactggtaaacctaattccggcgttattccaaaaccgttagatcgtgatggtaacggttctttgatttatgataccgaaaagcttccaatgactgggcaatggtgccatgagattgatcatgaataccgacgaattggctcaccttcaaactgtgtgattgattattgaaaattaacccctcgtttgaggggttaattatttattacgaccaactaccagttccgcgagtcattaatattacagacggacgcaagtagctcccatagacgttcgtatactcctccttaacgcttattgttacgctcgacgctgtctttcctttcactgctaaaggtatggttacatccatcgcaggtccattggcagctcgctcaatcctccttgtaattgatgttccacctatgttagcagtcacaattatacgacttgcctgatttgatgtatatgcagttaaactataacttaataacaacacaaagtctttagataatgttgaaccggatgagtctttgaaagtttttgtccaggttcttgaacttgtagtttgtgtgtttggtattgcagactcagcaatgacacacatattcgcaacatcacccacaaaactggtagcttccacagtacccttgaatttaccgcttgtggcgttgactgtacctgtgaaagacccgttgttggcgtataccgtaccccttatcgttacgttgttaaactgagcgctaccattcttgttaatcatccaacccgcgctattgcttgcgtagtttgttgactgaatttgatttgaaattttagcgctgtcaatagtaccattttcaataaacgcagccttcatgaacacttgaccgttcttaacagcaaatgctagttctgctacgctatttgtcgggttatagatagcaaagttgttagcgcttaccatgaagtaagactgaacagctccaccggacccttccatacctaactggataccagcaacgtatttttgccctttaccatctacctgtactttagcaccccattgagcgttaacattaccttccagatctacaactgctttacttgtctcctgcacggtcgcgctaaccgtttcaatagtcttaccttgagtgtcaatcaacttaccctgtgcatcgatgagctgtccttgttcattaatggtaacgccctgatcctgaacaacaccatctaaagtgataacgctttgttgaacattgctaacgctttgacttaaacgctgttcagtttctactacagtttggctaagctgagtaactccatctttaacacctgtgatttcagtagtgagctctttataagtctccgtcttcttgaattcagaatcaatttgtggcatcaaatctgtagctgttgtaaagcacaatgcagctacttctacaaatgcagatgatccgaaagcgttaatggtgcgcacataccagtaataagtgtggtcatttttcaaaccttccgaagtccaggttgtgcccatacctttacgagttgcttcacgctcaacaacgtctgtagacacagatgacaatcttgtttcaccggaagtccagaaatcatactgcgtgctaacgtttgcaatgtccgcagatttagggatcaggtttatagcaaagtaaccctgttgtacttcaatagatgttggtggcggcggagcctgaatattaaattccagatatgcttcaggcgatattgccccgctataagctaccgcttgaacatgcgctgtatacgcgccccgcagcaacccagtaacgcgaacgttttggccagggacttgtgcggtccaaaccgttgtacctccctgtcgcacggctacgcggttatacgctacctgtccaatattgctccatgttaaaacaccttgcacaacatcgctgatctgcaatacctgatactgaaggttttgcggttgagcaatagcaccagacggaaggtctaccagatccggacgctccattggtttaccaatagcatcgtcccacatttccaggaagtcttgacgaaggacaagattaattccacctttaggatcgaatgaccatttagtaacgcgcatctcaacatttttcattccaatatttgaaattgacacgtcgacatacatgcccgggcggaatttataccccttcatgttacacggcacttcaattgttcgaccaacacgcttacgacgtaaaataatattagcaagacgttgagcttgatattcacttgtaacaaagcggaaatccatgtcttgtgttatttcgccgccatctttttccacccattccttaaccacaactggaggaaaatctgcttcagcgtatgtttgcttcgggtcgacaaatgtacctgtaatggtattggtgcgctctttataagatgtttcagggataattttaatatccccagcaatgcagctttcgtccaaagtcatggtagctggaccgtaataagcaccaactaacagaccgtgtttgccgccaatataggttagttccccaccgcaagcttcaagcatagcatcaaggattttggcaggtgcttcatccacttcaaactcaccgttaatgcggtagcgtctctccgtagtgctatctgcgttagtaacaaactcatcgcagatgttagcagcttccttgaattggtcccagttaatattctcgtccttgcgctttaaatacgtgcggaaataatcaagaataacaagagcagcgttatcgctaaagacagtttgaccggaacgagggtcatagactctacgtccctttttcaacaccttgacgtttggcaaaccggatgggaatttttcagcatcaaactttaagcttaaacgtagccatgcaatacccttgccaatcatatcctccttccaggaaggacaatgtcttaacatgaatgggtcaacagtctgacggtcgttatgaaactcccaagtagcgttttcaccaaaccaatcaattccgtcatcacccaaccaaatcgtttcaataccttccaatttatgactagcaagaacaacaacaagatgcatccattcaccttcatcttgatctccagcttcttcctccgcaaatgctaatagtccggacgctacggtcgtgccatatacaacagaacgtgacgctgtagccgcacgcagaacctgtttacgctcttgctgccccttgtaagcatcaaagttcatatttggtgtcttagttaaaagagcacctgccgcagttgcagcaataccgataacgagagcggtagttgccgaaataatactagccgcagcagccgccgacgcacctaaagctatcgctgctccaattattgctggtggcattagaccctccaaatatccgtaattttgatcttattaagcgggaatgtttccacaccgttcggacccatagcccatacatatccagtccataatatgccagcagttaagcccaatgctccctcaaatgtaaccacatcgcctctttgcgcatagttcttgtcaacgcgttcgctgaggtaagtatccaataacaatggaaggtaagcggttccaactctttcaatagtgaattttttacttccaagctctgtactatattttccagcgacttgttcgtagatatttgttccgtattgcgcatcaacacattttgccgcgaaggtgcagcaatcattttcaccccaagaaaaaggagtcgatgacaactcctttactgtggttaataaacgtgtctgccagcctggcaacttactcataggagaaccctggcgcatcttttttactcccccaaaagattgaacgttcagccatttgtgcaatatatctaaagaaacggtcgcccggatataaacgctgttgactttcatccgtatagcgatccggtaaaccttgtgaccaacgctcaaacacgttggaaataacataactcagtgcattctgttgacctgcttgtaacgctgtatccgtaataaaaccttcaaataaaacattggcagcggtaacgttaccttgatcgttcattaccgcaatataacaaacaacattgcgcccgataacttcttcgtttaacgtttccccgacaagactcatgtccagaccgcttaacgccatggacattgtgcttgagcttgtgctgttttcttctgttacagatcctacgtctccaagcgtaccaacacccaggaacgtttgaccgttaataacaacaacacctgtcccagtatgtacacgcgttacaccagaaggaaagtcgatttccgcagcaagaacaagactaacgtttggctgctccattgcattaagaagcgtatcgctgaaaggactgaatagcattagaacgcctccgagaattttaaagtgaatgaattattaaaagctggttgacgcttaactccgttagtattgtcagataaacggaaagctccttgtggcttttgagtttcaattttagccccgtttggcgggatagtccttaacattggagcaatgtttaaaatcacgttaccagaagaatcgctccacgcatcttcggttattaattttaattcgttatttactgcgatgtaatccccttcccatagaacctttctgttaggagtccaacctttagttgataaagttgtccctgtattgtttgcaccattaaccacaggtgatccaatcggtgcgcgtccccaacgaccaaaatcttgaagcataattcgaccagctttaccatcaagcttagctaatgtcgattcaagctttctggattgccagtcatttaagttgctgaaagttaatgttgcttcccatcgtgacccaggataggacacagtttgtgaagccccattaaaggggcttgtaaattcaacagagtttgaaacaagataccattccatctcggaaggtctaatttcttcgggccaagtgagcatatattaccccattgcagttctacgaattgttcctcgggatgcaaagtcattaagaactttattatatccctgctcagcgccatcacgggctgctttttgcatagcttgtgtgagtgctgcatcgccatttccttgcaccgtgatatactgaacaatgctaacaccaccggacatattcacgccaccttgttgtgaagcttggctatccaggaagcgatttaacttgtcattagacggagcattaagtacacgttcacccttatccagcaaccatgtaccttcacgcggaacgttatcaataccgtcgtgagccataccagcaattgctaagccacccacagtagcggctgacgcataacccatagttttcactatagccgccatagttgcgcccattgtggcaccgccttgctgtgtaccccatgcaagcgccgcggatgctgccgtttccgtgttggcaaggattgacgggatttgcattgctttctgtgctgcaaacatagctttataaaagaagttctgctggcttacagcctgtgacagtccatccattataacgcctaaggattcctgagaaaaggatatcattcggttcataagaactttatccagattttctctttccatacttgctttcttcaggacttgcgtctttgcatcttcgtagagcttataatgctcaagatcatccgcttgttgatccctgtgaagcttcataatcttttcttgcatctcgtattcgatttgcgcgtagtctgtcataccttcatctaacagaccctgagcaaacttacgattcttcttacgctcgtccagtttcttttgagcttcttctgcatcgtaaattgcagcagcaagactaacgacttctgctttttccgcagccgttgcagacgcattgagcttattaagtgccaccgcttgcgctttcgctttggcgttttccttaacccctgtggttacttcgttaagcttgtttcgtaaatcgtcaataaccttagcgttttgttgatctgccttaatagcgtcttttgtagctttagtccggtttctctctgcttcttcaagatcgtagtttttgccaagagcttgggctaaatcttgagcatatttaacaagctctttagcggattcgcttgttgcttcagagctaacatcctgccccatagctactttgcgaataagacttccgtatgtatccgcatccttgcccagcgtctggtacagtccactaaggattgcagcttggcgagcattaccagcgcccttaaccgtgttaacatcaatctcacggttaacgtccccgagttgacctttaaagcgatccaatactttttcgtcaattaacggaccggatttaatgctaaggacagccttcatatccgcagcaagctgacgtgctagagggattattttctctatagcggggcttgtcatttcaagcacattgttatatcgacgttgtgcgtcttccgcgcgttcagcagctagcttgacgttatccgtagcaatctgtaagttcttttccgcactagcagtatctcgaccggatgcagctcgacgttttaattgtgcttcgtagaacttttgcgtttctgttgcagattttaaagcggtctgttcccgcttcatttgctcttcaagctcaggaaggattgctctagctttgaccgcgttagctgccaactgagcttctgtcatttgcatcagtttttcgcgtacactatcaacgctatctgcaaactgattgttttccgcacgacccgcttccagcgacgctttataggaataaattgcacccgctgccagcattgctacaccaacaggaccgccaattaaccccatagcaccgcgtagcacgctcattgctgtagctgcccggcttgcggctggtacagttgcgttaagagcagcattgagcgcttgccgcgcttgtacgtccgccataattgccgcagaatgcgcacgggtagcattaataagcgcaagacgagcacctgcttccgctgccgtacccttagcaaccgctaatgacccgcgagcgacctgtaacgcggcaagagaagcagcacgatccgccgccgctttctgtgcggtaacgccaatagagctttgcatcaccgccgtagttgccgcagtttgtgcagcttccatctgagatgcttttgcagcagctatagacgctttagtcttagcaagcattgccgtaatgatacgggcggtaatcactgtggctaaagctgaaccaaccgttacaaccgttcctaagttttcggataatgcaacaaacgtctgtcccaatgcagcaaccgcaccttgagtcttttgggattcacccataaacttagtcaggttgtttgttgcaactgtccattgctggttgaacgttggcatagtgcggctaaattctttatcaattgtatccgcagcaccagacaacgatttgataaccacatctgatgttaactttccgctgtacgccagctcacgcaattgtccaatggtaacgcctaacgaatcggacatgatttgagttaagcgcggtgcctgttctgcaacagatcggaattcatccccgcgcaaaacaccggatgccatcgcttgcgaaaactgaataagagcagcacttgcttcatgggatgttgcaccggaaacaatcattgctttgttaattgtttccgtgatacgtccaagctccataccagtcataccagtattcttcatcgcacgctggagacgggagtacagagttgcagtcgcttccaagcttgtacgtgaccgctgggcaatatcaaacacgcgttgctgcgcatccgcaacggtttcattacccgtacgagccagttcaagtttgttggtaaggatggtccaggagtcagacagcgatataacacggctaatagtgtcaacgctaatcatgcctacaattgcagcatccaaacgacttgtgacggttgcaagttcgttagatgtgttagacaatgttttatagctggaggtaacacgttgagcagaccgctccgctgtgtcacctgtacgcgctaagttccgcaacatagagtccgcggtactaatccctctcgcgtcaactctgattactagcgaagcggtttcggccattatcttctcctttttcttctacctttattttgattttgcatttgactttccatgagtttagcattttgttcagcttctgacacgcgcttttcaagccatagctgccgcagtatttcgcattcgtacggttgaagatgtaagcccattgtcacttgatagctgtgcaattctgtataactaaaatctcctccagtgtagatatcatcaaataaagtagatagatattcgaagcaaatcggtatttccttttcccgatattctttaagcttaggtggcgtcttaccagactgttcctcaaccttttgcagttgcgataataaagaagatcccccgccggggactttactatttagttcccattggaggatcttcttatcaattaactgtctgcgcgcttttagaaaaaattactatctttagcggcaaatacgttaaggtcttctcggacagttgggttctccgttaagaactcaaacacgttgtcaacagttgggggctcgtcaaacgtccaacctgctacaagattacacagtgaacgggtaaggatgtcttccttcatagcatccgttacttcaccgtctttaccctgcataagtgccaacagttgacgttgtgctttcaattctgcgtcacgatactctgtgcagtagcgactacgaatgtagagtttttcgccagtgtcgcctacaccaggaataaccacattcataggcttagtgtttgccggatcatttgcccggctcacagttttaaaatcacggaagcttttagctactgcaactttggcttttttggtgtcggtcatttcttatccttatgctgccgctaaaacgcgggtaattttgatggaacttgcggttgttgggtccagcaatccgcggtagcccatattaagcatgatatcgccttcaccgtcaataggacgcggagcctctgtgaatttcacgcgagggatttccacagtgtatttttgttgcggattgcttgggtcaatcaaatcaaacttgattgaagtttccacttcgtccagatacttcttacgcagtttgttatccaggaagtaaacgttagctgtaccagttacagcacggcgaccagcagacggttcaatggagaacttcgagccaacaacgaagcgcggagagatatcgttttcaacggtaagaccgatttccgtaataacgctaatctcctgaccgccttccagcaagcgaccggagaagccgtccatcggtgaagaagttgtacgagctttgatggaagcaccagcaggaagtgattcagcaatttccatcgagcgaccaacaatgccgaactctactgtggtcatgttttcagcagacaatgagaaagtcatgctgttaacttcacaaccgcgatagattgtgtatttacctgatggcagatctgcgttatagtctacaaaagtaaatgactggcgaacaataccacctttaaggacgttgtcctgccattcaccgcgcagtgctgccgcaatgaggtcgtcaaacgtaccgaaggacatttcacctgttaccgtaccttcaacgcttcgagcgccaagacggaagtctgcggtttctgcgtcatcacgcagttcttcagactccagcgtcgcaatgttaatatccagaccggaactcgttacacgaaacggggtaaacttcgcgcttgctggagttgtgttgctcacatcttctttgacgtaataacacgaataacgtgaacctgtagccatatttagatcctctcttacctcggctcacgagccgaccaatagattgtaataaagttaacgtcccagttgtcttcaaccccgcctctggtaaaattattcagcgaagtttgtccaccctgcgaaaagtctaagctgacaattcgtatcgtgtggtcatccgggcacgggatacgcaagcccagtttaaactttttccgaatggaatccaagatttgattctgtttagacgttccagtgtttaacggactgtacactgtaacttgatagaatcctggaatttcattcagaccgttgtcacctaacgttgccgcgtatgtagatgcaggtgcattgattgcctttaaccacatctgattcgctttaggtgtaaacttcttgttcttccacgctatacctatatccggtccaacggcttcgcgtagcatcttattaaatgcgtcattgataaaatcgtatcccagcattatagttttccttctacaatagcttggcgtatcaacattggtagcttcgctacgttaatacgcaccatgccatttggcgcttgctgcgaccaaccaagatattcaagtttcggagcatacggggttaagttgctaaagtagaaagtccagtctttatcatctggcaactgtcttacgataaccctagcttccgctttagctaattccccagtaggatcgaggcggatagtttccgtcgcatatggtgcaccaatggatgaacgccaaccgccttttgtacgtccggtcttaacaggagtatcctgaattacattctccgtgaacttgacaacaacctttttggcttgctccccagtctggacaagcaccttttgacttgcacgccgtatatccgctccgaatcccattatcgcgtcaccttgaaagtataaagaacagaaacattagcaggtcttgtatcaacgaactcgttaattgtccatacttccaactcaccatcaggagacatacgctcaatgcgtgcagtcattgctttatctcgtgtcaatggtggagtcattggataggttaagactttcaattcgccagtagcaacaaggctcccaccgatcattttttccttcggagaaagaaaagctccgataaatgggtagcgtttttcaacactaggatcgtcccactcatcttgaccttctcctttttccatgaccacaagggtacagttcacgccagcgtcgttgatcatttgctttgcagcttcaactaactgctcataaggaaagctcataaatcaccgtattaacctgttacccatttgataacccagcaaaggtgataaaaacgtcattgctttatcgtaagtctttgctggtccggattgcgcggtactaccagttgcatattcaatctcaagcccttccactttagttcttttgactgcatatgctgtagttttaccgttaagaggaccgccagatgcagagtccgctgtaagctggcaaaccgcgtttataagcgcctttggcaaagggctttggggtagctcgaacccatccacaaacaccccgtagcgtggccaatttagcggttgctgtgggtccattttgtaacccttaaaccgttgaccgtacccttccacaaaatccatagcgtcgaagatctttgtctttagatcttcatcttcacttggaagtacaatacctcgcattgcggcatacatgcggacttgttcaatggtcacataactgttggcgtcagatacaccagtaccatcttcaactatcagtggaatctccatctttcttcctcattgcgatggttgtagggataagtggcgggagcccttcttcaggaacagaaacggcgtcttcttgacgccgttttctattacgtcggaggagccacaacacatattgtctatggctcatttccatgattaacctcgacgcatcatattacgtgcaaccatacgggcaaccggatcgtcgatagggttctggaagcgatggtcagaaagcatgtcttcaggtttacgttttttctgcgcctcgagatacatctgagttgcagtaagaccggacttaggacgacgactttcctgctcaacgataatcttatccagatccgcttgaacgtcggcaatagcaagctccagcgcgtgcttagtgtcagcaatctctttaaccacattgctaagcttttcacgcttcgctttcagttcttcatcggttaagctggaagtgtcaccgattttttccggctccagaagagcacgcagtgcttcgctaatcttaacttcgatttgcatcgttgcaaccgcgactttcttttgttcttcatgagctttctcctgtttgacagcttcatgtaaaactggatcagcagatttaacaggttccactggctctggctcttccagcacgcggttatcgcgggtaaacagcggagcagcagttgtaatatcgtcgcgggttaaagacgggttagcggtagcgaaacgcagagcgtcaactttaggtaagccatcgctggtccaatgattcgggttatccggatcaagttctaacaatgcttcaattaatgtcttcattgtttaatccttatttttaggtcacattaataacacatgtaccagtaacactatcctttgccttggacgttactgtcaagtttgaagtaccactacttgcggttgtggtcacggtaattgtaccgtccccgttgtctttaattgtagcagaggaaccgtcaactgacgcgctatacgctttgtttgtagttccgcctgggacaaagtttattttaacagtaaccgtctttacttctgaagttgtggtgtcaatcttagcaggatcgagagtaatcgaaattggctccacctgcaacgatttttccatcaagtcatgtcgttcataacgttgataacgcatggttgttctcctaaaaaagaggggacataaatgtccccaaaatactacagcgcggcgttgagtgaagccttaggaaccctgatactcacgagtgatcaggcgtgcgactttaagctgcttgcgctcagggaacgcacgacgccaggaatcttcatgggccaggttgttagtggtagcagcgttagacggaccacctttagcagtttgggcagcagcccaagcatgaccgaccggatgcagaatccattcaacacggttgtgaagaacttcttcaccagcgccattgttagcagcttcgtcacgaaccacagcggtcggaacttttggtgaaccagcacccattgcagtcgcgcccgggccgaacagccagctttcaaagataccagtagccggatcgtgcggcatggagtcgtcttcaataatacgcagaccctgataatactcaaactgagtttcaccgcgagcatctggaatgaagtcgatcaggttcaactgacgcatacggttacgaacggtagagtgtaccataatcatggtcagaccacgagcagcatcacccatcgttgccgttgcgttgatgaagttagacgcggtaaagttggtctggttgtttacaaacgaagaaccggaaatatcgaaagtcaaatcgtcgttatgggatttcttcgcattagcaaatacacctttccaggttgcgatgtatgcagcttgcagacggcgaacccaccacgcagacacgcggttgccgatagcggtcattgggtcgttaccaatcaaagcagataccagatccgcagaaccccaggattttgaacgactcatacgaacctgaacttcagatccggtagtgatgtttgacggtttggacggagcacctttatcgatcgcaatatcttcgtcttcgtctttcaggtcattatagaacggctcgttaaaagtcaaacctgcaccagcaaggttagcagataaacgctcgtccattacaaccgcaccggattggatcagggcagaaagttcagcggtctgcgtctgcacataaccagtgaagatctcagggacaatgacatccttcaaacgagtcaggtcagtttcaccacgaccaaatggtagaataattttagatttagacatacttgtctccaggaaaaggattgatttgtttactgttggtagcctttccccgtggaaggctgtttaggaacccgtgtccctgatgtgttgaaacttaacatcagggacgtcgggatgtcaacttatttcttagcaggacgtacaggcttcagcggatctacgccattcttttcagctaagcgtttagctaaagattggttagttttccagaggttcatctgcttagagatgttccaaccgtcgtgactgtatgggtcttcaccgtgatggcctccagcgccaggaccagatgcaccaccaccagcagaaccctcgacccagtgaggacgtttcgggaggatctcgttaagccaatccgctggagttaggtatggagttacaccagccccatctttcgtaaccacattgccgttctcgtcgacggtcatctgcaactgtgcataagttacagcgtcttcgatagcagatggacgcaatttagcaccagaagcagcggcaataactgcatctttaatcttcgctttagtttcgcgagtgcggtagccttcaatttcctgcttaaccgtgtcacgctcggtgataacagtttgcaattggcgctcaagcggcgcaagacgagctttaaccatcttttcgatgtcttccggagtacctttaccgttagcggcagcttccagttgagggatacgatcaaggtccgcaagaacttcttcaaccggacgtccaagtgcgctaatctgttgcttcacctgacgatgatcgttacgttcttttgctaatgcactttccagacgacgaacgctatcagcaggtgctacacctttaacttttgcaagaacgtatttaccaccctgctctgcgtaaagggcagcaaactctgccgggatctcttccgcagatgcatattcgtattccagttccacatcaccttcaccgcgagcgcgtggattaattagagcaaaaccaacactaatagctacagaactctttttcatttcttatctccgttgtcacccgtgtgacgtttttggggctgagccgtcccagccccgtgttcgttaatataaaccaatcaatttggaagttgcaactattctttatcggaagcgtcgtcttccttaggatctttgtttacttgctgctctgcgtttaaatcagccttagcatcatcgggcagaggccacttcttaagctcttcttcaagaattgccatttcttcttcaaagcttagtgtggttaagccctgatcaacaagccagccatgaatagactgcaagctgatcggagccttaaggttgcgtgcagcaataatttgaacaaagtcctgaccattgaacatactcttggtaaattcaagattaggcttaaccacaaccttctcgggatccgcacccatccatttagcacaaaccttcagcaagttttccaaacctgccgcaccagtatacgcaattcgaatcaggctagcggtacgcgcagcaatacgcgttttcatagcttcgcctgattcctgcgtgctcttggtgttgttcaccatctgcccggctttaatctgagcttcttgtttatccgctgctagtgcaaggcgttgctcggacaaaccgtcaccgctaacgcctacatatttagcgtcaccaccaatagcaacgttaatgaccgctccaggaccgatgcgctgaggggctttatctccattctccccagtgccgccaacaacaactaatgtgtcctgcccctgcatatgcagactctgacggtaatcagcatcacttcggtacatgcttaggcagatgttagctagccccaacaatggaggcgcttccggtgctggtgtaatatctgttgtattgacaaactggaaaggtatttcgtccagcgtgttacctttataataaggagcaatcatttgcccttcatcataattggtattgttgataaacaaatgctgggagtagaccgccccacctgcaacttcatctgtgtccatcgggcctaattgcaggacgcgataacgcttctcttctttccagtcaaactgattgacacgtacaggaccgctttcatccagaacaaccatgttcaagttgatattacctaattcatctttaccatcatcccagttgataatggataaagcatcataaacgctaatataaggtctgttatttacatcctcacctttcggcaagtccagcagcaggcccaaacgtccattttttaactgcatttcgttgatgcgacgtagcagagcaataatgtcttcaccgtccgcagtacacagctcccgcatgtactccatttcaggaggaagctggattgtaggtggcttctggtgcaacagacctaaattgtttgtgaccgcacttgaataatcgtcagggaagttagcacgcaggcgataagcgagccaacgttgaaagcccaaatcattaggattattcatcccatcaataatcatggaagctaaaggtggtagatatttaacaccttcttccttaattttatcttcaccctcataacagtcgttgcacttaacccatgcatccttccacttgtcatatagcgggtgagttgcatcaatacccatataccctccagttaaataccgatagttttaccaacacctgtataaacagcttgatccagaaccatataacgtacttcatcgcccatatggtcttcgcattccgtatcaacgtcgtcctgatctacttcatcgcgcggaagacttggaaccagttcaaagaaataattgcagttatcgaaaacatacattgctggattttcacgtggtcccggcaaaggtttaccgtttgcatcttcccgcaatgcagctttaagaaactcacgcattttctgccatccgcgtttacgcgacccagcagatttatcacttctcttccaatggataccgttatacagcttgccgttaagacggattttcttcgccattgttgcggcggtagagttattgttctccagatcccaaatagaattatccgcaggtccaggaactacacggtcgtgtataccccaggccaattcccgctccagtataccgcttgcaatctctgagtccagcaaatgtagaccttcgtttgttttaccgttagtgccgtaccattcgttaatacggaacaagtcaccgcgaacagtagagaatgtagtaccatcttcacgtacaacatccgaaccatcactaatagcccaccagccgacagagaatggttttgaagaaccccagtcgaaagaacgtgtaatcttccagcttgaaggaattggaaatggacgtattttatgaacagtgctacgccacagatcatcgaacataccaccggaggtgatatcccagctaccgcccaaccatgcagcgcgtttgttcgggtctgtgatggacataagctctgcaatatatttcgggctcaggtttttgttctcgcggtaagatccgaagatatgacattgcgtcgtaaccacatcttcctctttctgcgtccgcgggttaaacactcgcgtagttttcctgagtatcttacccatcggtgcagcgtcaatgaagcgtttcttaacccagttatgccccgcaccaaacgggttactggtagcaaacacttccagaggaatgtctggtaaatatgtaacagtaccgtccggattgataattggattatcttcgggtaggaaggatgaacggttacaggacatcattgcttcaaacaaacgcccgtccggatactttgttaattcgttccatccgataaacgggtattcgtgaccatgataagaccaataatccttttctttgcaagcaacacggaacagcaattcttccccagtaggccaaacccatttataatcagacttcgagctaaggaatttagcaccatctttaaattcaggaaaccaacgctgtgacttagttacaaggtcatcaaggtttttatattcacggtcgaatataatacccttccagaatttaccgtaccctacgccaacattcttacggaaacgcataagctggcagtctgtttttccaggaccgcgagtaccgtggtataaaatgatatcagcaggacaggataaagcgagcgtctgtgaacctggatgtggcttccagactactcgcggcatgttatcaggttgtcggtttagctccatcttcagtctctttaactagtcgttgttgagactcggatgcagttttttcccattcgtcaatatttgctacagcagggactatcattacgccgcctctgttagtaacatcaattttagccttcttgggcgcatccaaatcataaatttgtgcaagcttgcccaatgcagctactctagcagcttgagaagatcccggtcctgtataatgagcttcacgttttaatgcttcaatgatatgctgacgctctaggtctgcttcaatgttagcttgctcagaagtacgttgaacacgggatctttcaatctccttgagcttccatcgaacgtaacagtccgtggcaaagcgttggccaagctcctgtgcaaacatagcattgaacccgcatctcatgcaagcgttagtccaattgtagtcgaacatatactcagcaacaactttgtcacgtattgccatctcgtcagcggacaagctatttgcatactggatatagttcgtccagtcacgatcatattgctcttgacttgccccgttcatggaagctccccttcttattgctatttaggctgaatataattgcttgatcctacaaaatcaagcgaaacattttcagcttcatagcgtatgatttccttaacccttagcttacattcagtcagagcagtttctgtatcctgtaaacgtcggataatatctcttgtgtaaaccaaaggaattttctcaacttcccgacattccaccagtagatgtgcgggtagtcttaccttcactatctgtggggctggaggaggttgagtctgcgtcgagcaacctgcgcaaatcatcaggaatacgctcgttaagataagctttgacgtcggcattgcttttctccagtgtctgcaacttgtcctgaagcaacttgtggttatgttgttcgttctgaattgcagaagttagtttcttgaaagagtccgtatctttctccctttgtgcagcaagaaatacaacagcttcgcccagcttagcattgtccttctccacaacggttaaacgttcttcagctaagcttaaatttgatttgttaagctcgttttgtgaccacaggtaagcagccactccgcataaaaacacaaccgcgccgatcatcaggtactcgataaacagacggggcttagcttttataaaactgaagaagttatttagaatcattttcatgtttgcagtcctctgagtcgagtttgatccctgtccgcgatgctagaagcgactttagagcttttagcgtagcacgtgaacccgcccaagcgaataggccagcaaggccaaaagcgaaccaaaggctgatattaaactccctgtagatcgcgtacattataacgccaaagaacgcggcggataaaccttcaagacatgcaatgcttatccgtaccttcttaccagcgtcaattgtacgcatgacgtaaccgagagctcccccaatgagggagatcagcgcaaaccccgctagaactgcccaatgttcgttcgatgagttgaacatgttccctccaataaaaaggggctgacgccccatcagttaaagtaccattgcaatagcgcggttaattacgtcgtccgtataaggcatcatgccattttcatgacgaatgattgcttttaccaaacctgacattatcgtcttgtcgaagacattgattggatcgttaggttcaacaccaattgctttggcaacagagcgaatatacgcttccgtatcgttttcgttaggcggtgcccagcgagcgataatttcacgtacagtatcaatatttttcttacccacattgggtaagccttcgcgtttggtgtagttagtcaggactttagctagagcacgaataccgtagatcggttgcgtaaactgtgcaaaagatttatcggttcgtttatcaacaggtactaaaccctgccaattgtcaccccagcgaatatttcctggattgttgttacgaataccacgaggttgaagcgccatatcgagttcctccgcttgacatgaacccatgaagggtaacagagaaacttgatacggcgcaaggagaattgatctagatagaacagtgctcaaaccattcgttaatgtaccacttaacaagatcttgtccacctttgtcgaccccgtaactggagtaaaaagtgaactgatctggttcgtgttgcaggataaccataaagtcaggctgagtgctgtcaataattgcaatggcgatttcctcgttatctgtgataaagatttcgccaccaattacaacatgcgtcccgtggtcaactaccttgctcatataagcaggtgggatcaggtgactgaatgtagtcatttaaaaaccctcaaacgatattgtgtcaactcccaggaatgcgcatgtagtatgtttaatagccagctcaatagcttcgcttgcgctcgcaccagcagccaacgcaccagcggcaaacacacaaccgctaccctccgaaccccatccatccagcatgggttcgctcaaagtaccatcattataaataaaatggcaagtgccttccggagtaacagcaagaccgcaagtttgcccgtaatcatcatctttactgtaaagtttaatatcagggaacttaacaggttccgcgctattaaaataacgcaacacctgatcggtaaatgccgtcaaaccgcacaagcccagtaaaaaccgtccacgatgtccattcacgctatgaactttcttataagcagtcacagcttccccgcgcataacgccacggtccgcagctaatacttttccatcaaacgcaattgtggtcatttaactttcctttggtcttggataataacaatgcataaaacaaatagaataagacagatgcaaagccctgtacttgcaaagattcggataaccgtggaaggttgttcgactactgtataggtataaagcccagcgaacattaacgtcgcaaataaaaacaatccggcgtatagtttggtcattgtgtacccctcttattcgatgggtacacaatacaatgaagggttatgtgatagcaagaaaattaataaggtaggatttcaacgtctttgacccaagtatgaatgataaaagctccaggttcctcaggatcttgatccggaccaacatagaactttttaccttcccatcctttaattggatcgtgcacaataaacttgtgatccgtcatatcgatcacaatctggtgcaatgcgccaggaatattaagacttggcactgtgcacaggaacagacctcccatatgcaaagtttcacgcccaccaccttctgaacaatgatgcttgacgccgtttttagtcaaatattcgctgatagtgatttcccagttgttataataacgactatgaaattcctcaatgaccttctcaacaggtttattaaggatcattgccaaacacgcagaaacgcatgtatttaaagttggctgtttaacgtgttttatcatacaagcggttctccggtatagttacaccagcagcgtcgagcgcgagcccaagcacccaataaatctttaggcgtgctcttacccatcgcatatttaacgctgatttcgtcaaatacttgggcagttcgacgcatagcatggtgttccggtaaaccgtcccgatccgcacgctctatcatttgtttagctaatggagtttccatcttatgcctcgtatatgacttccggctcgttattataaggacgcagcagcaaacgcgctaccagcgccgtacgctcgcttaacccttgcggatgtacaaacccaacgaactggtaatgacaaccgcgcaggtggtgtaagctcttagcacaatgacacgcttccaaacgaagtgtctcgcccgactgccatttaaccacaatggtggagctcgcagtcatgttaatttctacgtcaccaatatctatttgaagacgcaaaagatcttctacaacattacggacatagacaaggatctgtgatgtgggcataacaataagcccgttccagtctttcccgcgtcccaagccgcaacgacgtgcgaatcttgctattaactgagtttctgtaacctgttttacttcaaatgacttcttcagttggcagtctttggattcgtccattgcatcaacaatagttttaacgtcagccattatttactccgctaatgtgtaagggataccggatgctttaatccgtctgtacatatccatagtaccagctccgccaggaaacacaatagcgtgatctggtttaggatcagtatccagcattaattggttacggtatgcgccagcttgtgcattataagcacccttggcgttataccgtatcttggtatttggtaaggaaagattgtcccacggggcagggaacgcttctgtcgtaataccgttgcgctccgcccaatgtgcacaaatccggtcaacaccgtcagcgtcaccgtggcgaagtgtggttatccttctttgcatatgcagcttatccagttgagcataaatataatccacatgcttaaaatctcgacctccggtgacgactaatagcattatttcttcaccaatggtttcaacatttcatcaataaagcctttccaatatttgatattttcttcaatcaccatgccacctcagtacgctcgttgtcgcgttgatccattgaagggtaatataataccgtaaaaccagaatcagctaaccatttagcaatcttcatagtggtcgggtcttgagtgtcgggattaccaacagctccgtatttagttaccagtaatactttattgtacccctttgtagcagctgcgcgaatgctatcactaatgactgcaatatcttcactaatatccagcttatcacttaattcacgggcttcttgagcagtaatcattttacaatctccttaaaacggttatacagatcgcgatagaacaacggaccgttagcgttacgacgcaggaagtcctttgctacagcttccagagcttcgcagcgatcacgcaactcttgagccttcttctcggtatgcgcccacacctcttcgctggtcacgcccggcggattcattgcaccaacaatttgacgcaaacgaatataagaatcggatagagcgtgctcagcagcacgcatgtcgacaaggttagtttcagcattttcagcacgttcttcctgagctcgccattctgcttctaactggtcaatccgcatatcgcgataacccagctccgcagcaatatcacctttgccgtgcaaaccttcggaggtcattgccataacatgacgggagtaataacctccagcttgatccagttcccaagcgtcgcgctcacgatataaacaatcacactccacaagaataggttcaccccacggttgaacgccaccactatcaaccattcccgttccgttacatttttgacagctcattatcatctccacctgttacggtcatcacatttatattcatactcagtaataacctgaggatacgttgacacaacattaccttttgcatcgtaaatgtattgccagataatatcatcccgactattaccagtacgctgacaattttgcagctccatttctttggactctacaatcgcaaatacaacaaaagcggctaatataacgcctaatcaatgctaattttcatggctgacacttaaagtggttaacttccttcagtgtatcgcgccagtctacaccttcaagagcaaactcgccgcagtagcggacatgatgtccatagattcccatcatccattgcttaccggattcatagaaagaaggttttgcgtcatagcaatggactttaccatctgcgtctacagcaataaaattagtccaaggttcaacgggcacagcaaaaccgtaatactcggtatacagtttagttttctcgtcaacggaagggattgcgtgtccagtctcgtccatacctaaatataacataacaacctccagataattaagggctccgtagagcccattatagattgataattatacttcctccaggaaattaggacttacaagcccggtataacttacttcataagcgtcattttcgtcatcttcaaggtcaacatagccatctttaccgaaggtgacaataaccgcatgtggccaattgccgtcaggcgaagtagtgtataaatttgtcacaaccttattaactgtgacaattgccgcttgcggtaagacattaaaacaagctgcaccatccggagtatacccaacaccaccaatgtcagtcagcaaacgatactctttaccttcaacaatctcttctacacgcattcttcttgctcctctacatatttagtgacacatttttgaaaattaagaacgatatttttctcttttacggagtgaaatttaacacgttccgggcagataatccagccttcaaaacgttgagtagcgtcattccatgcagcacgaccataatagccgcgatatggacctaatcgcattgcatttacctctgtaaccacattgctggaggtgctgggtgtagcgcttgcactggagtcgcacataaatacctccgaaaatgctctggaactgatgagattaactagaaattggttgcatcgcttaaagatggtagctatggagaagctacaagacgaattatacgttgacgactcagaatttactaccaaaatccatatatttagaagaaatgagctgtatatattcaaaaagaaggtaggtggggtcatggatgtaggtggatagtaaagtgatgggtgagatttagacaagcacttactatcaggatggacagggcacgcccagcgctccaagtacctggaaaaggatgggtcgggtcgcgcggctgggcctgcgtgggtcggtgtgcgctgtgcgagctgtgcgcgaagctgtgcgcctgtttcgcccgagctaatgcattaccattgcctttgtgcattagctcgctagcgtggcgctgtgtgcgttatagcttaagctgcatggaacacagctaacggctcgcccgtgtagcggctgataagggcatattccttttccgtgtacttgtttaactcgcagcgtacagcaccaacgtcgccgaacattacgcccgtgagggtcatgtgtatataactttccatgttgaagtcatacactttacctactgtgaacagacccttagcactagccttagcattatcgtttacgcttacacatttgaaactacgcattttgtttaccccgttgtttggttgatgtgtgtagtatccaccagaccgatcatgttgtctaggcattttgtgctattaattgcgcgtagaactcgcgcccagtttgcatagcctgcgcccatgtagtctcttcgtactccatgcgcataacctgcaataataacgcgtgctgtgcgcgtgtaagcgtgtatttgcgtgccatagtagttaccccttaatgccgatgaagaacgtgatgccgagcgctttgtgcatgatttcgcgtgcggcacggatacctttatccttcgcagcatgagcggcttccatcgctgtatcgtgaacgatatttttggcggtggtgttgtccacgttaaggcggaaagcaaaatcggttagcgcgatgcattgacggttagcattgcgtgcaacaaccaaccctttttgcaggttaacgataatttgtttttcgttattgcaatggtcgaagaacgacatagtaacgatggacatgatgtgaaccctttaagttaatttgtagtacccttgcggtatgtgtatatagtagtgctagaccgatcatgtgtctacacctttttgcatctttttataaaaatatttggcagctttatatgtatgtgtgcgcccgcgcgaatactccagataatgtgatgttagttaggccattagtgctaaatatgcatggcaagcataattttcattagatgcaaaacaatatcaaaatagcacttttggcctattcaatatcacgatgtaaggctattattacttcaacaaagcaatactgcttaaccacattaagggttgcatcatggaattcaaattagtggaactcgagtccggtaaaatagctggttatgtatctgccccaagctgggaggaggccgaaatcttcttaatgggccagttcgatatgtacattagcgacatctacaaggaatacgatttagtacaaattaagtgatttatatcttgcctagttgatctgactgggcaataataagtcaacttaaacaaaacgaggattacatcatggctacttctatcgtcaccaaatttttggcaccaactaacaccaaaggcgcacgcattgcagttaaaggttttggcaagcgcaaagtctatagctgggactatgctatcgacgtaacgcttaaccataaagcagcggtacagcagttcctcaaagcgtttaacgcggacaacgacaccgactatggcattgttgctttcgcaagtatgggtatcgcgaacgccgatttcgtagcaatcgtgcaataagttttcttatacactgctcatcattacggtgggcagtaataagcaaactaatattaacgaaaggagctataccatgtctaaagtaactcaccgcgaacaggacaaaatgcgctacaccatgaaaacgaatgcacgccgcgcccttaagacccgctggggtcaggttgcacgcgatgcacacgaacagctaatccatcaggacgatattggtttttacatcatcgagaaggaagtgcttcaggtgctgcgcgatcacgaaaaagctcaaaagcccgagcagaaagtcccagcaccgaccgccgcgccagctgctagcgtctcggtactgcgcccgatggtaaatccggaaattgtcaaaagctgcctcgaagctctggagcaggaggaagagaaagatatgaaacacgcaaaagctgccacgcaggtttctgaaatcaaaattgaagagccaaaagctgccgcgccaaaacaggatgtaaaagctgctcgctgtgatttcaaaaatggcgctcgcaagccgctgaaaggaaaaactgccgaagtgtgggcaatgggcgacaaacttttagctgaactgggccgcacgccggagctgaaagagatgaaagctgcaatgccttcttacaacgggactacggtagccattcagttctacgcctggcgcaaatataacggtctggacgcataatctataaccacactgttcactgacgggcttctgcgggagccctaaggataagaaaatgcaattagatagtttcgcaactcaatacctaaaagaccttcagcgccgtgtaaatgaagcacgcgccaaagaaggcctcaagcctctaacgcagtcccagcttgttggcgaattaatcgagcaagctgccactcagtcaacattattcgtcggctctgtgttcgtaaggaaataaacatgaaaacgttcatccgctcttacactgacatcagaggcttgcgaaaaggaaccgtttatgaagttgccgacttcgggaataaaatattggtcccttattacaataaagacgaaaagccggttccaatgaccagcgtatgcttcacccgccttatgcaggacaagttccttgcagaagtgcaaccaatgcgcaaagaaggcacatccgaaatctggttcgtgcaccgccaggaaccggatagcatttggtccgactgggtaaacgaaaaactgtcgggtatcatgtccgacgatacgctagcccacttcacacctgtacaactctaaactacttccgggccagccctcctactggtccggttaaccgcgcaataaagtcctcctccaatatcccgcgattaagcgcattatagcttgatataccttccgatcacaatagttcaataatttattccattattccaattattccggaatctggaataatactgtatatccatacacaatattccattaacaatcctgtcacgaattgtattctttcactttttgtgagttttgggactttttaacaatgacccaaaaacattcaaataataccaataggtactatatacattaataataaatccttattttatatatatttatggtattacttattaacttttagtttctatccgtttttagcctgttgactgaaagttttaggtttttgcgctctggagtaccgattccattattctatcaagtaggaataatttattccacttccatcatttggatttctacccattccatccactattcatttagtatctatgctattgatttatatacgttttttactaacagtcgggatttgggtgttagggtaaaaaatgcgttttaccccaaaacgcaaaaacttactgcaccaacttattgtttttattaaagtttttagcaacagtggcaccacaaaacttcgcaaaactttgcaaaactcacaaaactttcggtcacattgcgcaaaccgtggagcaccaactattcctacccaaaactttccttcacatgtggttatatattaacaatccgctcacatcataacttcaggtggaataattgtggctgcattactatggattgtgtatagtgctgttaggaggtaggtatggactgtcaaaaagaatttgatcttaaatacataaccacatcagaaattgaaaaccgcttcggtcttagccgtcgcaagttgtgttcgctgcgcggtaagctgcctggcgaagttaaaattgctaatgtgtacgtttacgtccgcgaagttgcagagcctgtcttaatgttgcacgctggtcggattgtgtcggaggttggtcgtgggtcgtaagtgtcgcacggtgccggggagcaacttcaaagggcgcgggcttgcacgccggaaacctcgagtacctcgggagaatgtgagcgggcgtgagggcgttactttcgattacaaaacgggtaaatggctcgcccgattaacatgggtggatgcaggtggagaaacaaggcgaactttccttggactgtatgacagcatgaaagacgcttgcgaagtatatgacgcaaataattcagcatacgaagaatggcggaggaaacagatctatggctacaattgatccttttatgaaaaaggttaattcaaaatctgcatgttactattttggcaagtctttagacatcaacggttatgttgttgaacatgtagaaggtgaaggttatatcttatatattaaagttttggatagcgtggaatatgttaacacatttgcgtccaagcaagaagtccaggacacagttgatactattaaggcggcaattatatccatgttaaaactagcttgtaagtaaggatctgcaatggaactgtttcccgctgaaattaaagcttttccacaatgggcggtcgccgatgcggataaaaagccgcttgtatgggacaacgatatcggacgtttgatggcggcagacgttaccgatccggatatgcttatgacgtttgaagccgctaaaggttgcgccgctcatttcaataaaccttatattggcttcgtgcttactgcgcaagacccgttcacctgcatcgacctggatgtgaagaacgcaaccaatgagcctgatcccaagaagcacacgacgccggaacagttgcgccgcttcgaacagatcatgactgcgttcgatacttacaccgaagtaagtcgctcaggcttgggcgtccacctgtggttaagagggaacatcggtaaaggtcgccgacgtgatggtgtcgaggtttatagtcaggagcgttttattatctgcacgggtaatcctgtctataacaaaccagttgcagaacgtgatcattatcttactatgcttgtgaatgaaattgatcttcagcgcaagacatatgagattgaactggtagaaaaagatccggtagaagacgatgcgactattcaccagcgagcacttgaagcggacaacggggataagtatgcacgcctattcaatggcgaatgggttgaaatgggattcccttcccagtctgaagcagaccttgcccttatttccatgtatgcattttacacagaaagtaatgagcaatgtcgccgtctgttccgttacagtgcactgggcaaacgtgagaaggctaataagaacaatgttcatattgaccgttgcttgcgtatgtgtcgcggtcgcatggagcgtgagcgtattgcccaggaaaacgtagcggcgctggcgcgggattacgctgcccgtatgcaagccgcacacagtgcaatgcagcaggtaacggaaatgcctgtaaccacagtcagcccgtccggtgaaattgtagttgctgaaagcacgtccattgatgcaacagctattgaatggccgccgggtcttgctggtgagcttgcgaagtatatctacaaggcgtcgcagcgtccggtgaaagaaattgcaatcaccgcatcgttagcattcttatccggcgtatgcggcaaggtgtggaatactatcaccaacacagggctgaacggttactttgtgcttattgctcgatcaggtgtgggtaaagaaatgcttcacgctggacctagttatatctgtaagcaagtaggcgagcaattaccgcaagtgcatgagtttgtagatatgactaactatgcttccggtcctgccttgcgtaaaagttttgcggatcacacttcgtttgtgaatattaacggtgagtttggtaaaaccatcaaaggtatggcgacagctcaacctggcactgcaaactacaccctgaagcaaactatcacagatgtgtatcaaaaatctggtgctatggatgttgttggcggtatcggatattctgataaggctaacaataccaaaacgatggaaggggtggcgttcagcgtgctgggcgaaacaacaccggacacattctttgaagcgttaacccgtgaaatgatggaagacggtttcttgtcccgtttccacattgtgcaatatgaaggggatcgtgttcctgcaaacgaaaatcctgaaatcacaatgccgcaacaattaaaggacatggtctgccatctcgttaaccacacgttagtgacaatggcaaaattccagaccgttaccgtccagttaagccctgaagcggaaaggattgaacgggggtttaacttgttatgtgatgaacacattaacgcaactaaagacgaagcaattcgtcagccgtggaaccgtgcacaccttaaagctctgcgtcttgcctccctgttagcagtgggggaaaactggatcaatcctgtcgttcagcccaatcacatgcaatgggcggtagattttgttacgcatgggcaggatatcatgatcaacgcatgggaaaaaggtactattggcggtgatgatgaaacgcgtgtgaaggctatctgtcaggtctgcaaagattatcttggcggtaaaattgcatgtgatcgtaaggagctgcgagttgacggtattattccgaaggcaactatcacacgcagaacctacgggttagcagcattcaagaatcacaggatgggggcaggtactgcgacagacctgactatcaaacaacttgtagacatgggcgcgcttgttccggttacgcgtgaggatgcattgaagcgtaatttcagggggttgggatggtatatagacgagtcaattgagagtgttttcaaagacttaagcaaataaataaagggccgaaaggccctttattgttagttgagatagtaatcatcgacgtcgtaccttgccataatttcggatgcttccgctgcactttccgcttcttcataagcttgctcagcgtcgtcataagtaccgtaatacatccaaccttcacccattggacggatatatgcttcaaatttgccagtacgcgggtgacgtacaactttataatccgcgcccattgtgctatatactttattcagcatgaccattttgtaatcctccgttttgcttatgagttaatagtacagttagactgatcagatgtaaaggcaaatcgtgctattttatagatgcatttcaagtctaaagttgttgcatacatctcaagtcctgctatacttacagcataaagttaacggagggaacaatgttcgagcttttaaaattatttgcgggtgctattttcgtagctggttacttctggtttatgtatattctgtgaggtgtgagatggatcaacaattatctaatattgctttacaagcaatattagataccgcaaaacaggcttatattgaaggttataatcagtgtttaattagtgctgcttattcgcctgaagaaccttcacaaattgaagaagactggcagaactcttctgtaaaagctgcctgcgatagaatgattcaaaacttaaggggtaaatgatgggaattgtaaatactatctgtgaagcaatttatgcggagcttatccgtattgaaactaatctgcataaagaaggacgaaaagaaatcaaaagaattcttgtagatttccctacagcaatggatattcgaagagatggtcatttatactattggggtagtgaatacatcgacgaatgtgatggagggtgtcgtatccacatggctattatgaattaccctattgttccaaccgatcaagtaacaggttttgagttgatgttaaatgatggtactttagcactaaaagcggcaaagggaaccgcgcaaaattgaagcttgccattcaagactgcatcctttaagataaccacagttaacgaggtttaacaatttaacaacattaacttagtgaacgatgcttaactcaagcccttgaaagcggtagctgtacctccttacagcaactactttcgctgggcttcctggagcgaacaggataaacccgcaacttactgaacgatgtgaacgatgtttaacgcgacggcgccagatgtaccaaaccgtcaccagcctttggcgaggctgtacaatttaccggtgataggggaagctgaatagtcaagtaccttatctaaactaagcgcagcgtgaaaacgttgcgcttttttattgaggttgatttgacttcatattaaaataatataaaggaggtcgatatgatcaatgtaaacgaacgctttatttatatagacggtaaattgtttcaaagaaataaaaacggctataataaaagaccatttggtacaaaacgtcaggacggttatattcaaggcaagattgataagaggttttattttgctcacaggttaatatggcaatactttaacggacctatacctgaagggatggtgatagatcatattaatggagttaaagacgataacagaatagaaaatcttagactggcagatcgttcacagaacaattataatatggttattcgtaaagactcaaaaacaggagttaaatgcgtcaccattgcaaaacataacggtatccaagtttattatgcaaacctacacgtaagaggtgttttggtatcaaaatattttgattttacacctgaaggtttacaatctgctaaaagttgggttaagtctaaaagattagaattacataaggaatttgcgaatcatggttaacatacgacaaaagggtcagcgtgcggaacgagaagcttgtgattttttcaacgatatttatgctgaagtacatgagcttatcggtagacctttaccacctaaacctatcgcacaaagacgacagaatcaatcggctgtaggtggtgcggacattgataacacttgtcaatattgtgtagagattaaaaaccatgcaactcttgctgttaatacatggtggaagcaaactgttaagtctgcacgtgaatgtaataaaattccggtcttaatgtataagattcctagagctggttggaaagttgttatatgtatgaatccttccgtctttgatattaatgagttcaattattatatcaagaaggaaccgattcgcgctacaatagagcttgaagattttagagaaatcttcagagcacatgctattagccacattgttcaaacaggtacatattcttaataaggtgaaattatgactgacgtattaaataccacacaaagttcttatgcaattgatgttgaaaaatttgcctcagcattaagcacaataccactatgggtaaaacgcttaacggacaccgctattctgccagtgtttgctagtgctggggcagcttgctttgacctgcacgcggaccttaagagtgaagatggatgtgaacaaattattttctcaggtgactacatattccgaacaggtttagcatttgatatccctaaaggatatgcacttatggtgtattcccgtagcggtcacgggtttaaaaatgacgttcgcttagctaactgtgtaggcgttattgacagcgactacactggggaagttaaggtcaaacttaccatcgatagcaattggggctttactgttagtcatggtgaccgtattgcgcaagctatgcttatcaaggtgccttgcgtgcaactggtagaagtagacgagcttaaaacaaccgagcgcggtgctaatggctttgggtccactggtacgggcgaacttaaaaagggtaacggcaaagggtggaaacttggagacgagcagtccaacaactttgtacctgcgactgatgtggttacatctgagaagaagtgtctttgcatccaattatgacttgccgctatttgaaataggctatttatgggtaaacggaagaaaaagttatcaaagcaagtaatatctgacatggaaccctatataccttgtccgatacctgaagcgtataagccttcaccattaatggaggatgctgaatggaggaaggttgctagattactaatccgtttaaaaagattaattgatacagattgagtcttgcccaaacacatggatgtgttactatagctacatcgaaacaacacagaggatataaaaatgttcgacgcagataaagcagtacaagcaacagaagcagatgtaattgagtggtataaaactaaagcggaattgcagaagctgcaagctcgtgagcgagcactccgtgataagattattaagtcctatttcccagcgccgtctgaggggactaataaagttgagattactggcggggttatgaaaatgacccacaagattgatcgtaagattgatcttccaagccttaacggaatcctgggtgatttgattaaagttggtgttaacgttgaccagcttgtggaaaataaacctgtattgaaagttgcagcttggcgcaaacttacagcagaacaagcggcagtcttcaaccagtgcgttgaatcgaaagttggttcagcatctctggaaattgttccgaacaaagcctaaccatatcaaagggcggtgtatccgcccaagaggaaactaaaatgcgtaaagaatttcagaaagcttatcatgccctgttaaaaggtgttgtaactgtcaaagttaagtttgaagcaggtggtcgtctttatacctaccgtgctctggaaagcgatcaattgcagcctggtgatactgttgttattcaatacaacggcaagttcttcactacggaagtagtagaagtagatcagtatccggacttcagtaaggatgttgaatacaaatggattgtctgcaaagtggatgaagagcgatatacgcacttcctggaacaggagtacatgttcgaacaacagatgttggctttgtccgcaatcaaagaagcagaagcgaccaagaaagaactgattgagttgtacggtgaagaaaacgtcggttatttggcaggtattgctcagggaaaagtgatggtccagacgttcaatgacgttattgacactctgttgcaaaattttgcagatggtgcagatcttaacggtagtgttgttgagtttaaaaccggaccttataatggtgaagctgtacaacgtcagaaagatgtatatgaccaagttcttggacgcggtttgcgcacaatggaaggtccgcgtgtagactgggaaagccgttacaataaacacattgcaaacatgtatactctgaacggtttcacatggcatgactttatggtaccgggcgcaaataaggagaataaagaggaggtaaaagctgctaagattttgtttgatcgtttcaaacgcaaacagtacccgattgagaaatatatcgaagagttcaaagacaaattataaacggggggaataatggctgtaagaaagatcaaagcgactgatgcacttcctggaatggtttaccgtgacttttacggtaacgaaatgaaagtagaaagtatctgtcattacgagcaggataatacgatagcccttacctttgctttcgggcgcccaggagatggtttccgtctaaccttccaaaatgaagaagagattgaaatcgtgatccctgaagaaccggaagaatctattcctgcataacttacaagggggtctttcgaccccctttttattaaggaaaaacaatgagagtaacaattatttctgatgcaagtttttgcccaaatacaaaagccgcgggatatggtggatgggtagtctgtaaccgtggaaataatgctaatggtggcccattacgcggtgctccggataacaatgcagctgaaacaatggcaatttgtaatgtcatttgggaaggattgaaagctaatttaattcaatcgggtgatcatttaattgtgcaaacagattgctcaacagctattaaagtgtataaagaggcaagctggaaaagcgaacaggaaggtacagctttcaaatggttgaacgatcaacttcgtaaatataaccttactattgagtttcgccacgttaaaggtcatacaagtaatcaggaccagcgtagcaaagctcaaagattttgtgatgaacgtgcgcgttctgctatgcgattggaaagaagcaagatccgtttgcaggaatgcaaagagcttatttccgaagcaaagaaaaaggaaaacagacctaaaaagggtagcggacatttacgccgtaatacccgtatgaaagagaaagctcaaaaagctgcaatacttttagaacgttgcggtatacgcagcagttcccatcaacatgattattatgaatgaggttaacaatggcattcaaaccacatttagcgactgacgcggttgaagaaaagattaagtttccgtgctgcatactgcccaaaatcgacggtgtgcgcggtttaaatccggatgggcaaatagtagggcgcagtttaaagctgtttaaaaaccgccatacaagcgcgattttcagcggtcctcaatacatgggctatgatggtgagcttgcggcaggagttgaaacggacccggatctgtgccgtaaaacaaccagtgcggtaaacacaattgaaggtgaaccattcctgaaatggcacatctttgatctgtgcgcggaaagtgttgcagagctgggctatgaagcacgctacaacatgatgaaagactttataaccacacagcacgctaaaggcgaattgctcgatctgcaagttgtgccgatgtatgtggttaagtctttgcaagagctgctctactgggaaaacatctggcttgatatgggttatgaaggtattatcatccgcgatcctgaaaagccttataagcatgggcgcggtacagttcgcgaaggtggatatcttcgtattaaacgctttattcaggaagacgctattgtcctcgatattattgagggtgaaactaatcttaatgaagctactgttaacgagctgggaaggactacacgatcttcacatcaggaaaataaagttcctaacggtatgatcgggacgcttgtttgtaaagacgttaagacgggcaatacaatcaacgttagtcctggtaaattaacgcaagaggataagatttattattggaataaccctgacaagattaaaggtcggactatttcatataaacacttccctcatggtgttaaagataaaccgcgttttgctaactttatgcatttccgcgatgaaactgatcaggctttagattaaaaagtaattgagggttcaaagtatattacgttacaatgagcacgaacttaaaagagaggcgttaaatggccattgaaattaaaatgtcttcacaagtagtgcaagacacaggcgttaaaattctggtttacggcgaagcgggtatgggtaaaaccagccttgtagccacactacctaaaccaattttgatcagcgcagagtccggtctgttatctattgcagcggaaaaccttaatcgcgtttatggtaacatgggattgccgatcgtttatgacattcctgttatcgaagttaaatgtctggaggacgttgaagctgcttatcagtggtgtataactccagctaaccagcagtatttcgattctattgcgcttgacagcttgagcgaaattgctgaacaatgtttaaacaatgcgaaaaaaggaacaaaagatcctcgtcaagcttatggtactttgcttgaaaagatgcaagatctgatccgtaaatttcgcgatattcctggcaaacatgtttatatgtctgctaaaatgggcaaagacaaagatgaagtctccggtgttaccgcgtatgctccatctatgcctgggtccaaattggggcaaatgctcccttacttcttcgacgaagtgtttcgtctgaatgtaaataaggatcagcaaggtaactcatatcgttacttgcaaactcaaccggactttaatacaatcgctaaggatcgttcgggacgtttagatgcggttgaagtcccacacttaggttctgttatcaacaaaatgaaaggtatcaactaatgactatgccaactaatttccactttgacgcgagcagctatcaagcaccttcttacggcgcattgccgaaaggttggtataaagcagtaattgaagcatctgaatttaaaccgaccaaaaatggcggtatggcgatccaggtaacgtttagcatcattgacggttttgctaaaggtcgtaaaatcttcgctcgttataacgtcatcaatgacaacgaagatactgtgcgtatcgcttacgagcaactgggcgctctgtctcatgcagttggtgtaattcgctgggatactcctgctcaattgcataacattccgctgaacctgcgtctgaaagttcgttctcaggaaggttatgaagacagcaacgagcctaacggttacgctaacatcaacgatccggttaaatatgcagaaaaagcagcagaggctccatcaatgggtgctccagcagtagctaacccgtttggtgcaggtgcgccagcacagcaaccgactttcccgggcgcagcgccacagcagccagcagctaacccgtttgctcagcaacagcaagcgcctgtacagcagcaagctccggtacagcaacagcagccagttcagcaacctgtgcagcagcaaccagcaccgcagcagggcgcagcagctcaaccgtggcagaacgcagcaccgcagccgtgggataatcctgctcaaaacgcagcgccgcagcagcccgttcagcaagctccggtacaacagccagtagcaccggaagcagctcagcagccgtgggcgcagcaggtagcacagccgggccaggcagcagcaccacagcagcaagcgcagccacagcagcaagctgaaccgcatccggcacaagcagcagtcccgccgtggcagcagtaagttaaccctccctctgtagtgtccctaagccgtcgaaagacggcttatttttctaaggtactccaatggctatttatattgcagaaaaaacacttcaagcgatcaatgacggtgtgcaaaaagatcagggtgggacttaccgtaaatatcttggcgtagttattcccacaattgaagacgcataccgccctgaaagcggaaaccgcagccacttaggcgcttcccttattggacagcaatgtgctcgcaagctgttctacggatatcgctgggctacgcgtaaagagttcgatggacgccagctccgcctatttaaccgcgggcatctggaagaagcgcgtttcattgctatgcttcttgcggcaggtatgcaggtctaccagcaggatgaaaacggacaccagttccgtatcagcgaagctggcggacactttggcggttcctgtgatggtgtggttataggttgtccggacgttcagcctgggatgcctgtgcttactgaaatgaagacccacaacgataagtctttcaagaagctgaaagctaaaggtgtcaaagaagctaaacctgagcactatgtgcagatgaacgtgtacatgcgaaagcttggacttggcgcagcgttatatcttgctgtaaacaagaacgatgatgaagtttacgcagaaattattccatttgatcctgtcactgcggacatgtatattgatcgtggtgtgcagattgctattgctacggatattcctgaccgtgcattcaaagactctaccttcttcgaatgcaaatggtgcgaccattcctcattgtgctggcgtaaaactatgccggaagtaaactgtcgcacatgtcaatttcttgagccaaaagatgatggaacatggtattgcaatttccattccgcgtcagtggacacgcaaggtcagaaggttggttgtcaaaactatcaagtagctaactattacgggaaagattgattatgcagctccgcgattatcaacaggaagcagtttatagcgtattccgctattttgatgctgaaaagggtaacgcggggaaccctttaatcctgttaccaacagggacaggaaaatcgctcgttatcgcggggttcctcgatctgctttataaatggtatccaaaccagcgcgtaatgatgttaactcacgtcaaagagttaattgcacaaaactatgataaattaatgaaagtctggcctgaagcgccagcaggtatttacagcgcaggtttgaagcgtaaagaagtttataatcttatcacatttgcggggattgcatctgttgccaagcatcctaaaaagttcggcaaggttgatctaatctttgtggatgaagcgcaccttattagtccgcgtgatgcaacaatgtataagaagttctttgcagcattgcgtgaagttaacccgtatttaaaaattatcggtcttaccgctacaccttaccgactgggttacggctcaattgttaaggaaaacgaagacgatgatgctttatttgataaagtaacgtttgatgcaactacccctgaagcctttaactggttcctggagcaaggctatttacttccagttgtgccaaagcgtacaaagatggaactggacatcaacggggtaggtaaacgaggcggtgagtttattcagagtgagctgcaaagtgcggtgaaccgcgacgacgcaacactccgcgcacttgaggaagccattgaatgtggtgaagaccgtcaaagctggcttatattttgttctggtattgaacacgctaaagatgcgtgtgatatgctgaacgatatgggtattagctgcggatgtattcactcaaagcttgatgcaaaagagcgtgatgaaattattgaaaaattcaagcgtggagagtttcgagccctgacgaacaacaacgtcttaaccacagggttcgaccatccgatgcttgatctaattatcatgcttcgccccactgcctcggcggtgctatgggttcagatgttgggtcgcggtacgcgtccggtatatgcggagggttttgatctttccacgcaggaaggtcgcttgcaagctattgcagcaagccctaagcagaactgccttgtactggatttcagcggtaatacgcgtcgtttgggccctattaacgaccctgttaaacccaagcgcccgggcgaaaaaggtgctggtactgctccggttaaagaatgcgatgtgtgcgggtcgtataatcatgcatctgctcgctattgtggtggctttgcaccaattcctatggacagcgttacacaggaacaagttcaacaattatatttgaagggatttagactacgtggaacggattatgttaaagaaggattttgcggtcatgagtttaagttccagacgaaacttaaaaaggcagcaagtaccgaagcactgatcaaacaggacattccggtagttgaagacttcaaagttacgcatgttacttatgcgaagcacactaaacgcaatgacagctccaaacctccaacaatgaaggtgacttattattgcggtagtaaaatattcagcgaatgggtagctttgctgcatggcgactgggctggtcgtaaagcggttgcatggtggaagaaaaggacgcatcttcctttaccacaaactattgaagaagcccttgatgttgctgcgatgctcaaaacgccgaaatacatcaaagttcataccaataagaaatggcctgagattttgaactatgattatgatggtacgtgtttcggtaagtttgaagcaccacaggacgacgaagctattcaggttaaagtatacgggcaggatggaacaacagaaggtccaagctataatgatgatgtgagctgggatgatattgtttcacagaatacgcaaggcataacggtgaacaatgtggttaaccctgtacaagtagatgatccggattacgttccgttctaattgacttcaacatctaatgcccctactattggggcattacttatttataggggattgcaatgtacgtcctgattgatacagataaatttgaactcttggcaaagcatcccaattggctgacactacaccaacttggaattatttgttgccctgagtcaacactggtgacaccagtagacgatttacatgatcttggagatgttgatcttcaaatgctttatattaacttgacagaaaacttaggagctgcaccttatgaacgggaaatcgttgagcgcattttgtttgattactttacgcaacttccagaaacaatcctggatcacgcccaaatcagcgcacaagccgaattctgtgtggaatacgatatccaaggcttttgctcacctcaaattggacaatacgttccgtcaatggatgaaggactttggaaacctgcccgtgtcaaatacgatgctgaacgggagggtggtattatttccggtgccagggtcgtttgtgagcaacccgcattgcaagccgcatggacaccgggcagaggggcaaagagttagtaagttctaagcttgatcaaaaatatttttaaaaatattcagataaggggttgcgtgtcacaaaatcctttggtacatttaaccccgttggtaacaaacgaacccataacaattcggagtgaagagaatgagcaacattgaagacaaaaaagctgctgccgcagccgctgctgccgccgctgcaaaatctgctaaacctgcaaagaaagaagctactgtgaatgatgcagaagctaagaaagccgctgccgctgaagctgcacgcgtagcaaaagagaaaaaagaagcagagaaaaaagctgccgctgaaaagaaacaagctgaaatccgcactgaagcggaaaacaaatttaatgcgattgctaacgctgctgaaatcctgaaaaactctttggctaccgtcaccgacgaaagcactgttgaacagatcacggaagcagaaactcagggatctgcaaacctgaagaccattaaagaagctctgaaagagctgaaagctgtcgttaagaagtctaaaggtgaagacctgtccggtgctgtaacttctgctcagggtctggtggatggtctggaagctactattaaaggcttcaaagacaagatccgtgctgcaaaacaggcagaaaaagaagcggaaaaagcacgcgctaaagagctccgcgagaaagaaaaagaagctaatcgtatgccggaacagaacggtgttcgccgtccgcaaccggaaacttcctgcggtcgtgcttgggctctgatggaccagattagcgctacgctgggtcagcctgccccgatctcttatgttctgaacctggctggtcgtcacggtctgaacgaagatactgttaaaacccagtatgcacgctggaagaaatttaatggtgtgactggtcgcgtacctgtaccagtaccggaagccctgaacggcttgtaatatcaaaacatatcacgttataatgaaggcgcccaatgaggcgctttctttttcactagaggatttaagatggatattaatcaacaagctcccgagtctcgttctaaagaaaacgatatgtatttagacgtgcattcggtattctctaccattcagggtgaaggtccgttctgcggccaacctgctgtatttgtgcgtcttgctggatgtaacctgcaatgcccgggctgcgacacggattatactgttggtcgttctctttaccacattgttgatatcatgcgtttaatcgaaagccgtaagctggaatcaggcaatagcacctcacttgtggttattactgggggtgaaccgttccgtcagcaaattaacccgttcattgaacaactgttatcgcggggctatttggtgcaaatcgaaactaatgggtctatgcctttacctaagaacttttcccagctacctgtcattgtatgcagtcctaagacttcaaagattcatccttctgtgctgtaccgcgctaatgcatttaaatatgtacttaaagcgtgctgtgtaaacgtggaagacggtttacctcttcaagcattagatcatcaagctacgccatttatcgctagacctccgaaggggttcaagggtaagatatatttacagccaatggacgagcaggatgaagatcttaaccacagtaacatccaagccgttatccaaagctgtatgaaacacgggtacacgttgcagcttcaggttcacaaatatatcggggtggaataatgcgtgtgttaagtcaggttgtgcatactaaagatgttaatttttgtggtgtcactttaaccgttccaagtcgagttgattatctggcagccgacaaggatgggaaggtttgggggtatgaagcaattcctccagaactcagccatcgatttgatagatggctgccagcagatccgggagcttacgagtacgatgaaatagctgatgtagaccttgaaggcttagactggactcaaacattaacggaggtttaaatgatcactttggaagaagcgaaacagcatcaggaaatgatcactgagctggttgaaaaacttaattctgcaattgctcatgctactatgcagggtgtgcatgtagaattagatattaatcacgttagtacaattggagcacgtaatcatccaattgtaatgtcaaatgtaacaatcaacccttgtcatattaaaggtgtggaagatgaatgaagaaactatactgcttatgcagaagattcaacgtctgcaagacgaattgaatgatgccctgtgtcgcgcagcttcaaagaaaatatattcggaacttgaaattcacaagcgtcagatgacctgtgaagatgtagttgaacaagtagtcgttaaccttaatattagccttaaaggtttctaaaatgaataaattagataaactggtattccctgtaaaaaatcataactccgccgttgtcgtcctgtctggcggccaggatagcgtgacttgcctaggtcttgcgcttaataactatgataaagtttacgctattggttttgcatacggtcaacgtcataacattgagctggcttgtgctaatcaaatttgtaaagagcacaatgtcccgtttgttgtctttgaattaccagctttgaaacagatcggtaatagcgctttgatcgggaacgaaggtgatgttaacgaacatcacgaacagcacagtaaccttccggcaagttttgtgccaaaccgtaatgctctttttctgacaaccgcgcacgcttatgcgcagaaggttggagcccgatatgtggttacaggcgtatgtgaaacagactatagcggttatccggattgtcgtcagcagtttgttgatctccttgaagctacattaaacgttggatatgaaactgatatccattttgttacaccgcttatgcgtttaaataaagcagaaacgtttgagctggcggataaggttggtttcttgaccacagtaattgaacagtcccatacgtgttataacggcgttcgtcgcactctgcatgactggggatatggttgcggggaatgcccggcgtgtaaactccgtgctaaagggtacagcgaatttattagcaaagcttgatcttaccgcgaaaaccgcaccgctagcttattgtttagggtgcggtaacccaactatactactaaagcttttaaacccaacaaccagcgaataacgctgttaaaactggagaacaaaagtatgaaatttatcgttgcttatctggctgcaattacattcgtaaacctgggcttttcctatcttccaatgcttaacacgccgcttggcgtagtacccatgatggctttcttcgtaggtattatcttcgtcctgcgtgactacgcacagcgtaacgctggcaaaggcgttatccctgcaatgattgtcggttgcattcttagctgggtgttcggagatcctgcggttgtagttgcatccgttgcgtcatttgcacttagtgagtttgcggattacgcggtgtatacgattactaagaagcctttccatcaacgagtatttatcagctctttggtagctgtaccgattgactccattgtgttcttaagtattataggtattgttaatccgggatcaatggtagcaatgagcttaagtaagttcacagcatctgccatcctttgggttgtttacgaagttcattcacgtacagcgagagcgtaaaaatgaaagataatcttaataaaatctggcacaaacatgatggaaaagggatgcccatttttcttcaaaacgagcagtttgaagttcaattagctgacggttctcttaagaaaaaccataagcaaggatgggactggtataaaaaatcctgtgataacgtaataccgttagaaagggattcagttatatcttggcgatatatcgttgcggaggattatgccaagcaagctagcgaaggtccgataaccgagcacgagtttaaagaagtgatggaaattgcaatgacggttccagaagcacgttaccagagctatcctgaagataaccgtctgaccaaataccagcgccttatccgcggtaaagatattgacgggcatgttgcttcaattgttgtagatgtgtatgatgttcttaccgcctgggaaacaacgaacccagctttgcagcatttaatcaaaaaagcgttgcggccgggcgaacgcggtcataaaagtctggtagaagacttaaaagacattattgcgtcggcgcaacgtgcgttagaaattgaacagtctaaagaggtattaaaatgagttatacagtaattcgttcacatgaaatttgcgctggtcaccgtgttgtgggtcatgaaagtaagtgtcgtcaccttcatggtcacaactataagtttcactttaaggttgcaccgaaaaaagggtcgcaagaaatcaatagtattttgctggacgacgttgggcgagttatcgattttagtgtggttaaaactacgctctgccagtggttggaagataattgggatcataaattcctacactgggaagaagatcctttgattaaagctcttcaggttgatcttgaactttgtgacgaagctacgggtcacgatgtaagggactttgacaactcgctggtatctttaccgttcaaccctaccgccgaaaacctagctgcatatatggttgaagtaattggaccgcaactgcttgacgaacatggtgttcaacttgtagaatgcaccatcgaagaaacttcgaaatgtcacgtaaactatagcctgtaagtatgaccacattaacaacaaggaaactgcaaaccatgcgtaaagatactgtaaaaattgccattagttcattacttttaaatattgaaggttcaacagaactccgtcctgggttggaagagactcctgaacgtgttgctaaagcataccagacgtggttcggcggttatgatgtagatattgctgggttgtttaagacctttgaggacggagcggaaaacaccaatgaaatggtcattgtccgtgatattcctgtatacagtcattgtgagcatcacatggctcctattatcggtcatgctgttgtgggttatgttcccaatgggaagatcgttgggcttagtaagctgtctcgcgttgtggatgcttttagtcgtcgactgcaagttcaggaacgtcttactaaccagattgcagacgctattcaggagcatttaaacccgaaagctgtatgtgtttatattgacgccaagcatatgtgcatggagtcgcgcggtgttaagcaggtatgcggcagctctactattactaaagcgttccgtggcgctacagaactggagcatggtagcgatattggtaaagaatggcgccgtgagttccttgaagcttgtaaataatagatagctttacagatcaagcccatatcggtcataatactggtatgggctttttagtcattggggaaaatatgtcaagacaattaattttagaagctgcattctacaagcttaaagcaggtactgcggatgcttgctctgcaatacagaatgatgcgcctacaaatatcttaaagcagcagcttattgacgctaaacatcgagcggacgaagcatttaatgaagtgtggcgtactttagaactaattgatcagtttggaggaccgttccaaaaatgaacgtttttatggcagcagtttacacaaacggatatatgcccggccagcagcgttatgaaaagctgtccgagcatgagaaaaatatcacgcgcaatctgccccatattttggaatcataccactacgttggacgtcaaaagtatgttgatcagatgcgtgctgacggggctaaagtgtttctcgactccggtgcattctccgcgcactctttgggtgctcacattgatattgttgaatactgcgaatacattaagcgcaacaaagacatccttcgtgtagaagatggcgcagtaatggcgtcagtgctcgatggtattggtgatccgttgcaaacctaccgtaaccaacttgaaatggaagcacgcggtgctaaaccgttaccttgctttcactttggggaggacttccgctatcttgaatactacatgaagaactacgaatatatcaccatcgggggcatggtagggcgttccacggacacgcttaaaacttggctggaccgcatgtgggacaaatacatttgcgacggtagcggacgtgctaagattaaacttcatgcgtttggtattacgtccacaaccattatggaacgttatccgtggtatagctgcgactcttcctcctggattcaagcggcagcgtttggaagtgtggttactcctccgtggggtccaatgcgcgtatctgataagtcaccggatcgccaccattttggcaagcatgtttcaacattaactgaaattgaacaagacgctgtccttaaataccttgagcaaaacggtttcacttacgaacgtttatcaacaatctatgaatcacgtgctgccttcaatttatgggcgtatggtgtaattgctgcaaacattaacgctacccatgacggcacattccgtgatcgtgtaatggagttgttctgatggctaacttaagaagaccaaaaggtaaacgtaaatatactcacacaggtgtaagaattaattattacggtgaaaacagagtagtatttctccacaagacacctaagcagtggcaggatccgtcaggtacatggtttaatgcacaaggaaaacaaatgggactttatggataccctccaacatgtgaattagatttaaccacaattagagcaatcgaggaccgctaatgttagacgctcttaaatttgttcaaggctccgtcgctaaaaaggaactggtagaaggtcttaccagctttcttattcgtgatggacaggtacagggatttaacggtgttattgcactgggtagccctattgagctggatattgattgcaagcccgaagctggacctatgattaaagctatttcaaactgtgacgaaaccgtacagttaacaatgatggctaacggtaaacttaatatcaaatccggaccgtttcgtgttgctatacgctgcattgacaaggaaacgcctcacgtattccctgaaggggagttatacgaaatagacggtgctcgcttcgtacacggtgtgaagtctgttgctccgtttgtaggctcggatgcgtcccgcccgtgggcttgcggtattctgattaataacggtagcctgtttgctacaaataacgtcaccattgcggaatattggtttggtaatcaattccctattgactgcataataccgtctgttgctattaaagaaatactgcgcattaaagctaacccgacacatattcaggttagtaagaacaatgtaacatttcatctggcattcacagaagattacagaaacaaatcttggtattgatgaggttcatggtcagcttggttcaccagatgcatatagtgcgaatggtggatggcgctcacaaaggcaggctgcggtaatcatatatcataaagagtttggtgaagttggtcgctttatctgtcgccctgaaatgtttaaataatagcactttttgctaaagccctccggggcttttgaaaggtgtcaattacagactgaggaatcaaaaatgattacagagatgattttagttgcaagcctgtcgtctccattggcatctcatcagtattgtgagcttggcaaagagatttatcacgatggagtggaagtaaacacagttgttgagtggctaaatcacagtacgatgaacattgatgataagaaggttgtccttgagtgctatctggtggaggcaaataaagtttaaatagcacgaattgctaaaacacaaattaaaagattgggtatagttactccatcgaaacaaacgagaggatacaaatatggctaagttcacacaatcagatgcacaaatcgaagttaaagatgttggttttggtaaggcattcaagattgcgcaggcgtacgggtctagcgaagaagatgtgaaagttgacactattaaccttactgctaagaatgcacgtgagatcgcttatgcaatccttgcagcacttggagaaaaatgaaatgactaaattattttgcgtaatcaacaaatcaaaaactctgccgttcactgtaaacaatccgtatagcgctgagtatcagggtgaaggaaactacaagatttatggcgatgacatgacatggatttttgcgccaatcgatggagctttgttggaattcattatcgcagactaagttattaaaaacattaacttgcaaataggcggcctttaaggctgccttttttcgtttatgtcaaaggctaatgtctggtattatttaaccaaatcaactaaacaaggccgcaacatgaaacatttctatgacgcagccgccttgtccggtagcggagtagctatgggcggcggtttatctgacaacacaatcatcggcattatcggattagttatcgccgtatgctttggtatttttggcgcatggctgcgctggcgtgacagtaaagcgctccataaggcacttgaagatggagacatccgagaggcaatgagaatcaggagcaaatgatgagcatcaaaaataaggtaattggttcggcagtagctggtgccatggcgttagcggttccgttccttaatgagcatgaaggcgttgagtacaagccttacagagatattgctggggtatggaccacatgcgctggaattactggtcctgacgttattctaggtaaggtttatactaagaaagagtgtgacgcgcttcttgcaaagcacttagcaattcatcagcgcgctgttgataaagctctgaatgttaatgttccagttagcaccagggcggcactgtacagtttttcattcaatgtgggaaccagtgcaatgcgcaactcgactgttattaggcgcatgaatcgtggcgatatccgcggaggatgcgaggcgctatctatgtggaataaaattagcgttggtggcaagaaggttgttagtaaaggcctggttaacaggcgtaacgcggagattaaactatgcgtctcggaattgtaattattgcaactgtattactgactggttgctctggcctatcggctatttctgattttttaccagcaaaggatggcgtcgaggcaacagcgcaggtgggtgaatctaaccagaaaacaggggttgggctatcaaatcagacagacaaatctagctctatagaaagcgatatgcgcaactcaactaacagagacgtggactcatcaagccagaaaaagaccgccgctactggcctatcagctaacacaataacggctgaaaagattgaaattcatagtactgaaaactcaggggtagattcattagtctggggtattcttgccgggctagtttcttgtttgttaacttacttcactttaagatttgcaggaaacaaaaaaggagcctaatggctcctttctctattaataatcatcctcctcgaggttgtcaccctcatacactaaaaagaacccaagcctttgtaattcagctcccgccatgaagtaacccaacgcttcggctcgctctgagtcattttttaaaccatctaaagggtatctctcataaaatttattaatcaacatagcttggtcaaacttgcttgaattgtattctttcatttaaataattcctcgtctgtcatttcttttatcgtcatcatctcattggtgtacttatcactctcaccattaaggcatctgaagctaaatccgaatggtcgcttcatgcttcctttactccagtaattaccattaactccatcgatgtaaccttcagtcatacatcttgccagaaactcctttgacgcggatgatgcaaagtaacgcgtagtaactccagccgctttagccattctttcacagtctttatggcggtaaatgaacaccgccagatgctgcctgttaaatctctcgtagctctcgcagaacttgaacacatctagtaaaaacataaatcacccataaattaatgataatatgcaaaacaaaatactcatcaaatgaataggaattagagagtacatgacaaaattttcaacctttctcataaatcaccccagcagtcgtggattaatgtaaaccttatcaccaatcaggcaggtgtagtttttctcatcaagcatcggaagtaaatggtctttaatcttagccattacgccagcctgagcctcaaacggtctaaccttacgtgccgcttcatagagtgatcgcaaccccaccactcctttactgttctttccttgcttaataagaatatcaattagcttgttcatctctgcattatcaccagcgtgaccagcagcattagcggaagacaagtaagtcttactcagttcttcaaacataagaagagcttcttgcatcgtttcaagcccaatctccctggacttctgcggactccctccgtttggattaaaccagttacggatagtgtgaagaactgccgctatcctgattacctgcttatccattttacctaacgctccgcgcaacattgtgtgcgagtacttaccgccatctgcaaggtgcggctccatttcctgacgagcacggttgaggtgcttcattgctgaattactgacagttagttttacatcttgctcgctcattatttcatgaacaagacgaaagtaatctgcctttaatccaccatcaattggtttatatgttgactcgccctcatcatcaacaaacacacgctcaccaaggaatgacttctcgcgcacaagaaggaaacgctctgatacaccgataccgcgagcgccagcattcatgattgcgacgattgtttcatcctgcgcaattacagaaatgcaacccatagcaataaagctcatgttgttctctgcgttcgcacgcgcgatagatacgttaccagcatcccaggccttcagaacaagttcgctgttagttttcttcgagccatcaccgtaagtcataccaagaagtgagttaacacttgtcgcttcatcagaaatcacggagaagttgccctggcggttgttgattcgcgcaagaccttccggggtagtatcagataccggaaacacaatgtcgcacagcttttctaacttctcttccaactcctctttatcttcgaataatccagccatctcagatggtgacttctcttgcttcatttcttttgccagggctgacaatttagccataatcttcttacggtcacgcttgcgtaattcgttcaatcgctcagtctcagcaatcattggcgctagtgcgagtgagttaatagctgacttaccagttgatggaggctgactggttactacgtacagcgcggtaggctgctgagttccatgatactcaaccgtaaagcgaccaagcattgctgctgaaatacacccaaggaagtgcatgtaagctgaagactctgggaactgaactgagcgtgcgatattgcttgataatttaccaacgacatcacaatcatttcctagcgagatgaccggatatttgtcaccagttgaatcaatttctaccggagccttccagaatgatgcactctgtcgataaccattggcattaatagcaactcgcaatggtggtaaattttcagctgccgcaacagacattacttgttcgactgataatttatcttcgttaaaatcaaacatcttattctctctatttgttatcgatgggtataaatatacccgccgaagcgggtagtgtcattaacaaaaagtgctatttacttatactgagcttcaaacttatacatcccataaccaacatcatagccaacttcatcatcgcgagtaagttgccagccgtcaccttcgttgtcgtagatgtagccagcattacgacctaatccagcgtgcatggagacctggtaacgcttaccttcagtaaatgatttcttgagcggattgctgtggtcaaccctggtgcacagtagtgtctttgtcttaatgtagtgaccgttcatgtctatattaacccatttgccatcgaccttaatttgttcaactccatcttttgctcgagctttaaataatttgttatcgctgcttacccagttctttgtgatggtagtggccattattactttccttttatgcgtgtcatttcagtgatttcaatatacatcataagccccgaagggctttaacaattagtgctatttctttgctgcttttgcaattgctttctgaacaatgtcgaaactctcaatcaaatcttctttaaagtagtcaccaacaggccagcccttgccgctgtactttgctatggtttctagatcgtaatagttcaaatcagatggcttaagcatttatctcacctcatcaaaagtggcgattccagggatgaacataccaaccttccagccagctatagcaatccaccccgaatcgtgcttgtgcggacgctcagcgccattaatcacccattcgttcgggattgtcttaccgttaatgataagcggctcagcgtcgtatacagagtcttttacgaacggtgttaaaaccttcttatccgtgctttggataacgttagtgcagcgaatcttcatgctaatacctcgatttcttcttccgtaacgctgaattcttcaccttcataaacagccgtgatgccatcaattacaacatcgcgcttcgcatcaatgaagtactcaccttcaagttcaaacacctcaacctcttcaccaacttcatagcccatctcagccaggcttaatgcatcttcgtcaaacttgatttcgttgttgataataatcgctttcatctgatatctcctcgttgtcgatgtgataactataaccaatcagggctgaatggtcattagcaaaaagtgctattcgttcgatttatggattgttgcagatattgcaatgattcacttcactattgcatgtatagcaatattgcatcgattgcaatgattttctggactgttgcgaaatttngcaatgattgatggattgatggaatgaaggaggkcgcatcaactagttggttggttttagcttacacgaggagctttcctttatatacgcgttatggcttgttcaaccgtgtggagaaattgccatatttacgccatccacgccagtttacgcgctggttacaaaataaatcccttatataacaaccttttagatttattattattattattattatatatgttatcccgtaaccatgattatccaagatattggtgatatttttttgatattgcgcggcgcataaagatttagataaagagatagggatgcaagtggggtggagaaaatggcttaacagaccataacggcaataacagccttgatatgactagcgtcagcatgtaacaatttagcataacgtgcgattactgagttgaacgtgtaaataatgcttgcgacattcacccatcatggtaagatgctctcacactaaacgagaggagtagtaaaaatgagtaatacaattcgtgaagcaaacccgacacttggcgacctggtgcgccaccttgttaagatggcactcaattcagaggatggaagcgtaacagttcccgttaagttgctttacaagaatctttacggagaaattgataacggctatgtagcagccgactttagacctggcggcaaatattcacttccaaagcttaaggcttcctatgtttcaaatacagccagtagaatgcaggaagttaaagacgcagataagcgcgcaaggttctcttgtggagagatggattataatggtgatgagcattattgcgtaaaaatcacaatggtcgacggagctgttaagaatggaacccgagctaagacaagcagtcaattagaggagaaagcggtaagcgagtttaaagccaggctacttaagctttcccctagcgttgcaggcatgagtggtgatgaacttaagggcgcggtaactatgattaacgcatatcaggaaatgattaaggagactaaataatgtttgatttcaaagaggataaacttacttatgagcaggtgttagcagcagcagcggcagacaatctgcctcccttgcgagtatcaataattgcaaatggttaccgacaatctgcaaatctatggcctgaactggataaggtcaaagatttcgaactagacactggagctttaaagattatagaaatcctcattaatcaaggaatgagcagtaaaggtgtcgttggtctcgggtcactatataatacagtaaggaaagttaaaccattcgaaggtaaaagtgaagtaattatggatatcagagatgtcatcatcccaaaccttgataagcttggctatgcatgcctaatcggagataagatttacatcaaccctaaactgcttgatggcaaccaggactggacttacaaggttaagctgctggaagatgatttcaacatcgacgattgcgagaagattgttgacgagattactatcaaggcaattgatgagcaaatcgagaggctcaagcggaagaagaagtacctcctgaccggtaaatagcacgaattgctaaaccagttccgcagggatgcgttatagttatttcatcgaaacgaaatggttaatagaggaaggcaaatgagttattacgaagttatcgacactggcaataaatcattacttggctcaaagcgctttaaatgtaccggccaagggttcactggatacggctttgacgagaaagatgccatcctggaatggaaagaagctaaatacattggggagttcgacgaatgaaacacattggatggctggtaaacggaacgttctactcactaaccgacgcagtaagggtggaaagaattagagttaactgcggacgaaatgtccagattcttgaaatttacgcagaggaggaagtatgcgtaaggtactgatgatatgcgtctatgttgccatattcttattggcaaacctcctggtagcctcatttggtccagcggtaactccatttaacgcactttttcttatagcggcagacatggtattaagggacaggattcagtttgagagcggtgcggcatggtcaatactagcatgcttccttgccggatttgcgactgtattaatagcgccaggttcagagatgattgctttagcatctggcctatcatgcttacttgctggatcagcttcagcgattgcattcaaattaaagtctggtggattttttcagaaggcgttgccagcaaacgtaattgctgctgcggtagattcaattgcattcccattaattgctttcgggtctataatgccaggcataacagcagcccagtttgccgctaaaactattggcgcatcaatcatactattaatcataaggaaattatctaagtgacaattcacttccatggctcccctataacggggggcaagggcgatgcacttgctcggaccgcgtatacaaatggcggtgctttcgtgtcattcgcccacccgcagcagatagaattggcgtttaaggtagcgaatgcagtatgcatagataatggtgcgttctctaagaagaatagcggcaaagctactgactggcataaattctataatgactttttacccagatttatcgacagagaaaagttacgattctttgttatacctgatgatatcagcgggtgcgacaaagagaacgacagattaataagcgaacttccattacacctaaagcacaaaggagctccagtctggcatatgcatgagagcttagacaggctagtccaccttgccaacgagtgggaatacatgtgtataggctcgtcaggcgagtactactctatccgttcagagaaatggaagcggcgcatgaatgatgcctttaacgctctaattcagaggggctactcagcaaaaattcacggcctcagaatgctggatggtcgagttcttggcaactacccactggatcaggctgactcaacaaacctggctattaatgcgcctaagtggatatgcaaatatatagatatgaccattgaggcgtgccgagctcagactcacagagacgcatggatttcaacctcagatccgaagtttgcacttgagcaattaatcgcagacggcggcacaagggagcagatgctggcacagagatgcgcgatactcaggaattgcatagaagcagtaaggccaccatcaagggattcatggaatagcacgaattgctaaacaataaatcgggtagtcagctatgattaccctatcaacaacgaagaggaaatgattatggatactggaattttacgcattgacgatgttcactttgaccaggctgaggtcagtgtcaccaagttaacctttcgaggtaatgttgttagccttgacttcgatcctgacgactacggcgacggtcaaacacttatgcaatactcacctgttgcggcccgcaaattagcggcggcattaatcctggcggcagaagaggcggaagagcaatgattaccattaacctgtcttatgaacaagctgcagagctaaaagatataatgcagcactcactcattaacaagaattatagctgcacagaggtgctatcagaagcgattacacagattcagaaccaacagatagctgacgatgatgaactcccatgggacactgataccgcctggagccgatacgagcagatttgcacagcgctatcaggttgtcagctggctagccaatacaaatgacaatatacgaacacaaattcagtagcaggggtattgatatgctcctgcattatgtagacgagagatacgccatgttgatgcagaagacgcatggcggcacaataacgaggattgagatatgaagattcataatggcgaatacagtaatttttacattgatgagtgcgttgaactatatgaaggatatggcgagccaactgcgtgccatggagatgagcttggtatcagctttcccgaagagcgtgaggattgatatatgagcaagtacaaccgagagattatcggcctggatggaacgttaacgacagtcgatgtatatcgtgttctggatgcattccaggtaacagacccagcaattcagcacgcaatcaagaaaatgctctgtactgggttgcgaggccacaaggattacctcaccgacattgatgactcaatagaatcacttaggaaagcaaaggagctttacggtcagaagaagataaatagcacgaattgctaaacatcaatcgcagggatgcgttactattactaaatcgaaacgaactaggaagaagaaatgaaaattaaaattatcgatgttgattatgttactgatgacgagtctatcacgcttcgcgaatgcggcttcgagattggcgatgttgtagaggtgtctggtaagtacaacaacggagagctttcaatccaggcaatccgtgagactgattttgttaatgttggcaatgaggttagtataagcgaatttgaatatgaggtagtggaagaatgaaaccctctgagtggtgcaaaaagatgatggatgaggcaaaagacggcgaggaggcgatgacatactttgagttgatgaatatgtggcgtgagcgcgaggagaagaaatcgtgatttggattcacacgtactatactggcaagttcaatagcgtaatgcacaagaggatgtatgacagctatgaagcagcaaaagcacaacacgcagttctcggtggcgacattcaatcttacaagaaggcttaattatgttcggacttactcaaccgcaattcaatgcagtgcgcgcccaggctaagaagctaaacgaggcagtggataagctaacagccaagcagaagcaggataacgatatcatgaaggcagttatctgtgagttccatagcccggtcagtacaatcatcgagaagatgcggttcgtctgggttgctggttatctggctggccgcgttggtaagcgtgaagatgggagtaatatctatgattaatccattcaagagtttcgctgtttctatgggatggacttgcaggaagcatgtattcgtactctttaggcatatcaagtggtatgagattgagtactaccgcaaaggatatagaagtaagctggtatgtcgcaattgcaataaaatgatttactctaagattgattttaatgataaatttggattgccactatgactgaactatcaatatggttcctggctggcatgctgacttggatttatttcgtggtcatggcttgactcaaatgtttaatatggttagtattaaacacgtagacggcaatgaccgtaacgcgcatcgcggagatgaaagccgatagccgggctggataaagatacgaggcaactaccgcatcgccaaaagcaaagtgtaagtcggacttgcggagcattgtgaaagctcgccggattccgtaaccggcacctattcaagttctgttagtgtaagtggacagcacgaagacctcctaagtcttaggtactggttcaagtccagtgcggaacgccaaatatgctcacgttgctaatgttggcctaagggtggagcttatacctccataaagcaatcaccagataagtgatgtaacgcaggttcgattcctgccgtgagcaccaatcatggagcatcctagtgaataactacgaagtccgtttaacttcccgcctaatgggcaggcaatgcaaatcttgccagcaatcctacgaaggtaggttccctgctaacagccctgaagaagcagttgcagccgcaaaggcagcatttaagattgacctgacggttcacaaagtcagcgttgataaagtatccctcgtttgagattggtaatctcgcaatgtagtgtttcgccctcctcgtgagggctttttttcgtctctactcatggtacaatgacttttaaaacaggaggaatgacaatgacaggctatcaaccaaaaccacacgatggcgaaataaaaccaccgccaaggagaccttgatgattgagtctatagcatcaatatttggggttattgtcggatttactataatttacaacatctggaagattaggagttaagctatgtcagaagagaaaaagattcaccagaagatagggaacttcaaggagctctataataagaagtatggcgacattgccaatctgaaaattaaccacaagttcacgccagagcaggtgttcgatttggctgttaagtacttcacgtgggcagaagaacaagcaatcaaagcaattgagacggccagcttccagggtatcgtaactgagaaccttattcacaagccgcgagtatttacgataactgggttccagctgttctgcggcgtaggtcataatgctatcagcaagtggcgctcatcgcctgggttcgatgaggtcatggagttcgttgactcggtcatctttgagcagaagtatcagctgggtgttaacaacatcgtcaaccccggactgattggcaaagaccttggcatcgataagccgcaagaggttaacatcaacaatgcttctaatgccgtggtaaacgatgaggaagcaatgaaggccgccctgacttcggtaatggaaaaactatgaaaatactaaaatctatactggcatactacgtcctttcttgcatggcattcactagcggctttcttattggtgtaattattggagcaataaaaaatctatgaatacattagcatgggaggagatgacgccagccgaaaagctggcagttaaggcgctatccactcacagcttcgaggcattccttcgcgtatggttccagttatcgcagggtgagagatacatccctaactggcatcataaatacctttgccgaatcattgacgaggttattagtggggagcgcagggataccatcattaacgtagctcctggggccggtaaaaccgagattacatctattcactttccggtctactcaatgatcaggctaccaaaggttaggaaccttagcttgtcattctcagacagtctggtgaagcgtaactccaagcgtgttcgcgacctaatcaagtcccctgagttccaggaactatggccttgcaagtttggcacgtgcaaggatgatgaaattcaggttcttgatgagagtggaaaggttagattcgaagctatatcgaaagcaattggcggtcagattactggtgcaaggggtggatacattacagatagctacagcggctgcttgatgctggatgaccccgacaaaccagacgacatgctcagcaaggtaaggcgtgaggctgtgcacgttttactcaagaataccatccgctcacgtagggctagtagcgttaaaggtaaagctacgccgattctgtcaattcagcaaaggcttcatacgcaggattcaacgtggttcatgacttctggcggtatgggtatcgactttgatgtagtgaagataccagcgctggttaatgaagactatgtgaacgagcttcctgactggattcgtgagcagttcgagaaggacgtgctttcatctgaatcagttgagcgtgatggggtcaggtactatagctatttccctcaaaaggaatccgtgcatgatttgatggcaatgtgggaatcagacccgtacacattcctaagccagtaccaacaatcaccagtagctctaggtggaaacctgatcaacgtcgattggttcgtaagacttgatgagaataacaggccgccagtcaagtatgactaccgattcattactgccgatactgccatgactacgaagagttatagcgactactctgtgttacagctgtggggtcgtaagggtaacaagctttaccttctggacatggtaagaggtaagtgggaagcgcctgagcttgagcaaactcttctggactttgagagtaagcacagagccaccagtaaagcggacggtatcttacgcaaggttattatcgagaaaaaggcatctggtatcggtcttatccagtcagcgggtcggacgatgcgaactcctatcgagcctttcgttcctgatacagataagttgaccagggtgatgagcgcattgccacaaattaaggcgggtaacgtaattctgccagactctgctccatggcttacatctttgctaactgagttctcagcattcactgctgatgattctcatccccatgatgacattgtggataccacaacgatggctatcaactgtgaactaaacttagcggacgatccaagggctaggttgatgaggttagcaggtgttagatagcacgaattgctaaagacaatagccacggatggcatataattaactcacttaaacgagaggagatagtaaatgtttaaagctaaatttgtaaattacaaaacaccagcatctggttatattggtattttcactcctggtagggagtacaaactagatgtcattgagaatgacagatattatagaacatacgatgattacggcgtagaggttaagttcaattcactttttttagataattatgtttttgagcgagtttcagattccgagctgtttgacatgattgaggagccagcaagcctaaagtattatatcaatggcaacttggtgcaaaaaagctacttctacgagttaattggcgagctaaatgaggctgatagacttggcgccaaagtgtcttcagtcaaatttgaaatcaagttcgagtaatcaaaactctgtgatacactagcccctactcaggggcttttttattggagaaattacatggtaaaagcagacagctacgcaaacatctttcttaacgggagtgatggtagcgagatttacggaaggtttggcggccttggcttaacagctccagcgcagcttgagcagctttacgtcagtagcgcactggttcgtcgaattattgatatcgtgccagaggttgcacttggcgctggctttaacattgagggtatcgacgatgaaggtgctttctggtcgcgctgggatgatttagacctttcagatagtgtaatcgacgcactggcgtgggcaagattatacggtggagctgctgtagtggcaattgtcaaggatggcagggcgctaactagccaggttagggagggagctgaacttgaaactatccgcgtctacgaccgacagcaaattaaggttcagactcgagaggagaatccacgtaacgcgcgatttggaaagccagttacctatcgcattacgccaaatggttcggccacattctacgacgtgcattacactcgctgccacatcatcgatggcgaaagggttccgaacaacctacgccgcaacaacgatggttggggcgcaagcgtgctaactggtgacttaatcgacgcgattgacgactatcagaactgtgagagactggctactcagttacttcgtcgaaagcaacaggctgtgtggaaagcgaaaggtttggctgatttatgcgatgattctgatggatttggtgcagctcgcttacgcctggcgcaggttgataataacagcggcgttggtcaggctattggtattgatgcagagagtgaagaatatgacgttcttaactctgacattggtggtattgatgcattcttgagccagaagttcgacagaatcgttgccctgagcggcatccatgaaatcattctcaaggccaagaatactggaggtgtatcagctagccaaaacacagcccttgagactttctatggttatgttgaccgcaagcgcaagtcagacctgcttcctttacttggtttcctgattcaatttattgtcactcaggacgaatggtcagttgaatttaatccactatctcaagttagcgataaagataaatctgagattctagagaagaacgttaactcagtttcagctcttgttgctggtggcgtgatgaatactgatgaagcccgtgatacactacgagctattgcgccagaggttaagctgcaagatggtgatattgagcaaaccgctcaggggaaaacagtcgaggaggtagtgattaatgaagagtaaaatgcgttatgacagcgctaaagtaaaagcccgtttcgatgagaacgggtttctagtggacactccagtggttgctcgtgttggtgttcaaacatactacatgccagatggctcagagcgccgagagttccgaccagcatcagaggtgtttaaatccgattccctgcaaagctatcagggcaagccgcttacgcttggtcatgtagttgttaattcagataacgccaaggatgttgtagttggagcagtatctggtgcagctatgcgtcaggattctacagttgtcgttcctctaacagtttacgataagcaggcaatagaaaaggctaagtctggcgttgctggtgagctatcggttggctataacactgttgatattgagtctcctggctggggtagtaacgaaacgggtgagtataagcttgatggagagtacgcaagccaggatgatatccctgctgattgggtacgctttgatgccctgcaaacaaacatcgttgtgaaccacattgctctggtatataaaggccgcgcgcaagtagctaaactgaatctggacgcggaacaggaaaacccgtatactgataccgttcaatcaaataaagaggataaattgatgattaagattaaactggatggcgagcaggagttcgaaatcgccccggaagttgctaagcacatcgaagctgttaaagctgatgcagaacaggcaaaagcaaaagctgacacccttgaagctgagcgtgacgcactgaaagctaaagttgatggcattcctgctgaaattgaatctgccgtagcgaaagctaaagctgatgctgacgaactggccgctctggttgctaccgctgcagaagctggcgttaaagctgatggtatggatgctaaagcaatcaaagttgcttacgttaaagaagtatccggccttgacgttgcagagaaatctgacgcatacatcgatgcggcctttgatatcgctaaagatagtgataaaatggctgaagtccgcaaagcagttgttgctgcggataaatctgacgctgccgacgcgcctaagaaattagacccgcgcgctcgcctcgctaaattgaaaaaataaggagtcttaatatggcaattcgtcgtcaagctactgctggtatggttgcagatacctctctgtacaatatcgatggtgcctgtgtaatgtctaccggcgtagtccagggtgtcggttatgctgttggtgtcggttctgttgatgctgatggtcacaaagttctgatttccgctgttgctgataacgtatacggcgtcctggtgaagtcacactacgaaagcccgcgtggttcttacggtggtgttgttggtaacattgataacttccaggtcgcaaacgtaatgactcacggtcgcatctggatggttaccggccttccttctgctcctgcatttggtagtgctgttaccattgatactaatggttccgcaacaagcggcggcgcagtcactaccaactggaccttcgccggtggtttccaggcagctgacactgtgtctggcgaaccagcactggttgaagttcaggttattcagaaataattagcaaagctaaactaaacctcctccgggaggtttttttatgcctgtaaactggtacaattagtttcactttaaatcggaggaatgaaaatggctagcttcttggaattggtaagagataacattgataagggtttagcgacaatgcagcccgttcagttatcaactgagtttactgcaattaaagagattagggtagcaacatcaatcaccacgccacaaacaatatcaaggagtgatgaaacaaagctaatgtatacaacttacgggcttgctaacgtagctggtggttcatacacaggacaatcgccaaacggagtccagatgaaggttgagtttatgactgactcaactttgttcgaaatcaaaaccatcggctcaatcggcacttactcaatttttattgacggcaaactggtaaatgctgatgcattcgctacgccaaatggagaggcggtgagctggatgcaagttaaagctaatgacggagttatcagcgggaaacttcgacacgttgaaatctacggcatcaactcagcattcggagccttcgtgtttggtgctggcgacacggttagtcgtgaaatctcaatcaagcgcccgcttatttatcagatgggtgatagttatacttatggaactggtgctggattcaggactcaagcttacggctcatctcctgccgtaaatgacttctatgcattcaccaggtctcttggttttgatggtattgctgaaggaattggtggatcaggatggaactcagctgccggtcagtatccaatgtctcgcgtgcaaacaaggcttgcaaagctaaatcgcaagccgtcagttatctcctgggcgcttggatataatgatgccgctgccatcctgactggaacaaatagccaaaagctactagtttcgatgggtgagtgtctcgctgagactaggaaggtttatagtgacgttccaatcatccagattagcagcgcaacgccgaagggaattaccactggaattcagaaggtaattgatttggttaatggtttttgttctgataacgacattccagtaattaacataagtagctatgttactaatgctaactcggcaatttatacaggaacagacaacgttcacccgggaactcttggccatgagtttaggggaatggcaatggctcgcgaggttctgcttgcagcctcgggtcagaaatcactaacagtcccagttacgccgcgtgcatttaacgtggtagcaaggctgactaaaagttttggagttacaatcttctctggtgtagtaaatgctattgatgagaatgatgttgccggacagctatacttgcagactggtgctcgagtggaaattctctcagtatctcgcgcctaatatcaaacctccttcgggaggttttttattgctctttttctgttagactgtcaatgattattaaccaatcaggagataaagatggcttacacagaaattgctatggcggtagggaattcacctgaaatcttagccaggaacgtaaaaatgatgatgtcatctggatttcagccatatggtgacgtccagatgctaagcggcactctctttggcatgaaaatggccaagggaacagcaaacaacgttgaagactttatggtgacatccgacaccacagttcagggattgattaacagggttaaccgatatcttttgcagggctggaaaaggtttggcaatgctcactttgaggatggagcatatctttcagcacttgcgaaaggtgattttgtaagtgatgaagacggaggctcaggtgaagcaggcccacaaggtccgattggtccacagggtccagcaggtcccgcaggcgcagctggtccgcaaggtcctcaaggtccaactggtgcaactggcccagcgggtgcggcaggtgctaaaggtgacactggcccacaaggtccggcaggtccgcaaggtcctcaaggtgaaactggcgaggctggtccatagggtcctatcggcccaacgggcgccacaggtccggctggcccaaaaggtgataaaggtgatgcaggcccagttggcccggcaggattaactttccgcgggatgtacgacgcagctactgcttacgttaaagatgatgtggttacattcaataactctagctggtttgctaccgccgctgtgaccggagagaatccagatgttagcgattcctgggagttgctggccgcgcagggcgctccaggtccgcaaggcgcaactggtccagcaggcccaactggcccggcaggccctgcaggtattcagggacctcagggagagagagggcttcatggtgagcaaggtccgtcaggcccgcaaggcttgcaaggtgcagctggtccagttggacctcaaggcccagcaggtcctcagggtgagcgaggaatacagggtccggttggccctcaaggattgcagggtgtaaaaggtgatccaggcgttaattctacatatacactacctttaaaaaactaccttgtaatagcccttaatgaagaggagggggcgaggcagacattcagggtgccagaagacagttcgggagctgaaatagcttttgtggtcagaaataaagattcttcaaacacttcaccatctggagtttatgagctgggatgtggagtgactggtacggcttcaatgcacttttcaggttggattattagtaaccttaaccaaccagataaaataagatcagcctctatgctaattgcttccatgactaatagtcagcgatactttacgcagttagcaataggaacaaggggtgatctttttaaaggttgcttaaccaatcaggaaactggtgagctatggtacattgaggcttttggtaccaagccaagaggggcagggcaaaccgacttaggtagactctcagttaagattgagaaaagagttgatacagtagttggaagcttaacaaaattcccaagagtttaagctttgctcaaggatgagcacccatgcattgatatagctattgtcccaatcgaaatctcgtgtataattgacacgtaaactcataaacaaaaggatgcatcttaatatgactatcaaacttgacgctttcgagcaagaaaagattactaaccacctgcgcgctatgggtgttgataaggctgatgcggctggtatctggactgttaagcagctcaccgcaagcctgaataaagcttacgaaaccgagtacgaccagaactccgtagtaaatctgttccctgtaagtaatgaaatccctggctacgctaaatattttgagtatccggtatttgatggcgtaggtattgctcagatcgtagctgattacactgatgacctgccgctggttgatgccttggcaactgaacgtcagggtaaagttttccgcttcggtaacgctttcctgatttccattgatgaaattaaagttggtcaagctaccggtcagtctctgtctactcgcaagcagtctcttgctttcgaagctcacgacaagcttcttgataaactggtgtggtccggctctactgctcacggcatccctagcgttttcgactacccgaacatcaacaacgttgttagcgctggctcatggtctcagccaactactgcggtaagtgatattacaagtctcttggatattatcgagacttcaaccaatggtcagcaccgtgcgactcacctgcttctgcctactaccgctcgtcgtatcatgcagaacctggtacctggcacttctgttagctacggtgaattcttccgtcagaacaatagcggcgtaacagttgagttcgttcagtacctgaatgattacaatggttctggcacctctgcagctatcgcttatgagaaagaccctaacaacatggcaatcgagattccggaagcgactaacgcactgccggctcagccgcgcgacttgcacttccgtgttccggtaacttctaaagcaactggcttgatcgtgtatcgtcctttgaccatggctgtaatgaaaggcatcaccttcgcgtaatagcaattattgcttaccacttgccacccttcggggtggtatttttgtttatatgactatataatcaaacaatcgaaacaaaggaggaaagaatgaaactgttacataaaggtgcttgtgttatccgtcttggcgcaaaagattatcttccaggcgacaccatcgaggttgaagagttatcagttggattaaagattctggtagctgaaggcaagcttgaggttgaggatgaccacaaggcaactaaagaaatcgagcaggaagttaaagccaaggctaagccgaagaagcaaccaaagagtattgatgaagctgagaatggcggcgactacaaataaaccaagagggcgcttcggcgtcctttattgtatggagatataaaatgaatgaagaagtaattgcgtacatgcgcacgctttacccgcctcttaagggtcagcctgatgatgttcttaacgcatggattgaggtggcaaggctatttatctgcttagataagtttggcgacaagcaggttcaggcattggcattctacacgcttcacttgcttagccaggatatcgcactgaagactgagaatgattcaagccagacatcctctgaccgggttaagtcctactccctttccggcgaatacactattagctatgatacaagcacagcttccgcaagctcatctaaccttgaggcttcatcatggggtaagctttacattgatttgatgcgtcgtaaagttggccgctggggtttgattacgtctggtgggtcgaggtgctgccgatgaatcacgcactcttgcagcagcagatcaaggctggtattaatctcctgtcagatggtgatggcgctttcgaagctactacccagccaaccatctcgatagtaaatggctacgaagtgcgcacgcctggcacttcatacgcagtgaggggtgttatccgtgaattcaaagcgcgagacattgacggtgacatcatcaaattcggtgaccgtcgcggaatttttactgctgattcagttgtatcggaaggcgaccgcatctacattgaccaggaggcctacacagtcattgacccgcgaccagtgaagccaactggcacggtaatcgcctacaggccagtattacggagggctgctacttatggctaatgacgttgtaagtttcaggaactcaattaacgcatggattgatggcgtcactgatggtgtagaattgattgtggaaggcacgctaactaaggctgccaacgacatagttaagctatctccagttgatacaggtcgattcaggggtaactggcaggccactggcaattcaccagccgcacagtcactaaataattacgaccctgacggcagtgagactcgtaactctcttcgtaggcaaatctacgcactagcaagagatacaaatacgaacgtaatttacgttaccaaccggcttgattatgcgcaaggacttgagtttggttcatccaatcaggcgccttctggtgttcttggtgttgtccagaagaggcttggtcgttacttcgccgaggcggtacaggaggctaaacgtgcactatgaaatgatggtagcatcaagaaagctggttagcgatgctgcggttgatattgccggcggactaccagtggcttacgagaactgcggattcacgccgcccaaaaacggaagttcatggctgaagtttgactacacggaggttgatagtgttacgtggggattgcagagaacatgtcggtattacgttggcatggttcaggtctctatattcttttcaccaggtgagggtactgataggcctcgccaattggctgggcgattgtcagaagctttcgccgatggtacaatgcttgacagcggatacatttatgaaggcggttctgtgtttcctccagtgaaatcacaatccggctggttcattcctgtccgattctacgtacgtatggattaattaaggagatttacatggcccatcttagcaatggcacacaaatttttttgcagggttccaaatctgaagcggtagccgtaacagctatcactaacgcagctcagccagttatgaccgtagctgatgcctcaactttcgcagctggtgacttcattgttgttgagtcatcgtcatggtctaaactttcagaaaaacagttgcgagtagtaacatcaacggatacaacaattaccgttgaaggcattgacactaccgacccgcttcagttcccagctggcggaacggcatcgatctacaaggttcttacctggtatgagatgccttgtgttcaggacgtttcaactgatggcggcgagcagcagttcgttacctatcagtgcttggctgatgaccgtgaacagcagattccaacctataagtcagcggtaaatacgacctatacgtttgctcatgagttcaccaaccctatctacccggttctccgtaactacgacgagtccggcgcactgattgcgattcgtgcatatgtaccaaaagctggcgaagttcgcctgtggaccggaactattgcttttaacgaaactccaaacgtttcagttaacgaaatcgaaactgtatccgtagcaattacggtacgtggacgctacagcttcctcgctgcataacaatcaagccccttcacaggggctttttttatgttataatttcaactcaaacaaacacgagaggattatttaaatggctaagttcaaattaaaattaggcgcactccctgatttcaaacttcctgttaagttccagatgatcaacggagaagaagctgaggttattttcaacgccaagcatcgtaaggctaaagagattcaggaagtattccagactgaaggccttaaggactttgactttgttaaagagatttgcagcggttggaaccttgaagaggaatttaacgacgagaacatcgaggagctggtatctctgttcccagcatccgttctggcactgactaacgcttacatgcaagctctggcgggccagcgcgcaaaggtctaaagcgcgcagtatatctacaataccaaagagagccaacggacgccgaacttgaagctattggcatgcggcgttccgattatgaagatgaagagccagaggagttatacttcgatgatgacatgatgctggcatggactgtttaccaggcaacttcaactcaatggcgtgtaggtatgaacggcgctaccggaatagattattcagtactccctttcctctttgatgtgtataatgtcaaggacaaagagatgactttaaatgacttgcgaatactggagtgcaaagcacttgagatgatgcaagtaaggcaaaaataacctccctttgtggaggtttttttatggaggttacatggcagaatttgcaggtatcactcttggcgttgacgttcgccaggttgaccagggcacaaagtccctgcaagaatttaaacgtgccaatgagcaggctgcggctggtgttagcgaatttgttaacgctgagctagttgcgaagaatcaggctcgcgatactgccagatatctttctgagcagcgaactgctttccgtcagctgcaaaccgcaatcgacccaacggcaggaaaacttcgcaaactacaggaagcggctgacgcactggataaatccttctccgcaggagttgttcctgaggctgaattctaccgcttaagcgaggctcttgagactcagactaacaggcttcgcaactcacagcgcgcattgactgaggaaggcagggcggcaattgaggcatcaaaagccaaggctcaggcagctacacaggcggaaagattccttaagtctttgcaggctgaagctcaggcggcaacattaacgcgagaggagctgttaaagctcagggctgctgagttaggagtctcaagccaggctgcgccaattattgcacaaatcggagcagcagctgaccagtccgcagcggcattaacaaggcagagccaggctttgcaacgttccgggctatctgttggcgcatataagaacgcaatacgcacacttccggcgcagattacagatattggaacctcattggctggcggcattccaatctggttaattgcaattcagcagggtggccagattaaggatagctttggtggtgtagctaacacattcaggtttgcgcttgctgcattaaacccgttcgttgttgcagctggagctctcggtgttgctcttggtgctcttgggctatcagcttatcaggcttatcagaacacatcacagctaaaccagacgcttaccctgaccgggcaatcagcgaacttatcagctgcagcggttcagaacctagcaaggaatgctgctgaagctgccggagctactcagggtttaggccaggaaattgctaatggattggtcgcaagtggaaaccgcacggtagctcagatttcaattatcactgaggcaactgcgcgctgggctacggttactggtgattcagctgacgatatcgtcaagaacttcgataaaatcgcaaatgacccggtcaaagggctggctgagcttgataagcagtttaatttcttaaccgctggtcaacttaagtacatcgagcagattagggttacagagggtcaaactcaagctgtaacggccgccacgaaaatatttgctgatgtgatggagaatcgcttaaccaaagttgcagagtcgctaacgccgcttgagagggcttgggatagcttcaaaaacttcgtttctcgggtttggacagatatcgggaacagaacgcttggcgcgctaaacctaattgtagacgttgttgctggcactattgagcagattcagtttctgattggtcagggtgacgttcttatcaacaacttcctgatatcgacaatcaaagcattccagaatatccctggcgctgatggagttggtagtgagttggttcagcaatttgagaagcaaaacgaagggataaagaaagctaacgaggagttagttaagtcagtagctgagcgtgacgcaaggattcgtaagggtgagcttggttatgtcacctcaactcaggaggagcagcaaaggaatggagaatctgacgctgagttcgagaaacgcagaaagtcacgtgagcaggaacttaaagatattgaggcagcgaataaggcaaggaagactggagttaaggaccagcaagaccttactatcaactatgagtcaggcgtcttagctctacaggctcagcttaaggttcttcaggaacaccgccagattagtgatgtcatcagtaacgagcgaaagcagctgttcgcagaagaagcaaggtttgcaatccttaatgaaaggctggctgatggcactatcaccaaacagcaaagggcgttactgctacagcaagataaaatcttaggactggctcgtgagaaagctgagattggtgaccagattgttctgcaggaaagggccaataaactccttgatgataacatcaagaagactcgccagattaacgctgaagcagtatcaataagtgttggcgctggattatctcagcgcgaagctgaaaggaagcgagagttggcggcgctagaagcccagcagatttctaaaggcggctccgtagatgacactgacttccaagcattgttgcaggctcgtcagaatttctacaatcaggaagacgcattacgtggcaactggttggctggtgttaagtctgcgtttgctgagacggctgatgaattagcaaacttcaatcagattggttctgaattggcaatgagtgccttcaatggattgactgaccagattacaaacctggttactaccggagaggcaaactttaaagagtttaccgcttcaattctgaagcagattgcacgcattgcaacgcaattacttttgattaaagctattgagtcaaccatatctagttttggtggtggcggcggctcaacaggtacagctatagctaactttggtaaatcttttggctttgcatctggtggctacacaggtagtggtggtaagtacgagccagctggcacggtgcataaaggtgaattcgtatttactaaagaggcaacctcaaggattggcgttgataacctttacaagttgatgcgcggatacgcaaacggtggggtggttggctctggtcctggctatgcgactggtggacttgttggtggaagcaacgttaacgttggtggagtgaatgttaccgttcagacaggtcttggcggtggtggcggcaatgacgctaaacagttagaatctggtatcagggttatcatcgcggaagagattactcaatctttccagcagggcggaacggcttaccagttcttgcgtggttacagttaataaatggggcttcggcccctaaggattttagatggcattggaaacatttcgttggtgtacacaaattcaaggtggatcagcaaacttcaccaacgcgaataacgttagggtggttagctttggtaatggctacgagcagcgtgggactggtggctataggaccaataggcgcacatacaatatgacctacactaacactaactggaaggaagtgttagacttctgcttttcgcacatcattacaccttttgcgtggacaactccgcaaggtgaacttaagctgtttgttgtggctcaagatagcatcagcgtcacaccaaatactaaggaagtacagactgtatcaatgcagtttgtagaagttttcacctcgatgcagtaaactaagaccctacggggtcttttttattggagaaatatcatggcaacgccattaagcactaagtttgagaatcaattacaaagcttgttccctggtgaggtcgttacgcttatcgaggttgacggaggaaagtttggcgcaccagtttaccgctttcatggggagaatatcagctatacgccagaagaaatcatgatggcacaatcaacaggtcagccactgccagcaaaggcaatcactttccgtggagaagagtatggcgcaaggccttttggcattcagggtattaacatgacttctgacggcaaggcaaacaaggtaactctggttgtatcaaacgttgaccagaacatctcggcgctcatccgcacttataatggtcttgttcaggctaaggttactatctggataacccttcgtgagaatattaatgaagatggcaccattgctgatggggattaccgtaagctagtttacttcattgagcgacctaagcaggttgactacaacacggcgtcatttgaactaactagcccaatggatatggatggtatctacattccggctcgacttgttcagtctgtttgttattgggcacagcgcaatcagtaccgctcagggaatggatgtaactacatgggcaatcgatacttcgataaggacaacgtgcctgtgactgacccatcccaagacttctgcgccggaacggtgaccgcctgtaagttaaggtttggagctaacaatcaattagactttggcggttgtgcggctgcaagtctgcaagcgaaagccaaccagaactaaggagttgaaaatgaaattattgtgtgcttatttgatatttatatttttgtcaatgtttggattgtcattaacattaattctcaatatggctggtgttttatgattacacctaaagttaaactagaaatatttcgccacgccaacgaggtttacccgcaggaatcttgcggggttgtaactcaaaagggaatggcgcagaaatatcacaggattaccaatgtatccaaaactcctgagcaatcattcattcttgacccagcagaattcatggagatttcagatagtgaacaaattgtttacgtggttcattctcatactggtgacggtgccactactcgccctagcgctgcagacatttgtagttgtaatgagtgcgaaattccttatgtcattgttagcattcccgaaggcgatttgcgaattattgaacctagcacaatgcctttagctggcaggccgtggggtttgggcagcttcgattgttggagtttggtcatggaatttcacaagctacacggcgttaagctgaacgactaccgagttgattaccagtggtggacgaatgaataccctgacaatatctacgatgataattggcaacttgaagggtttgagttagttcgaggtaatgatattcccattggctcaatggttatgatgcagattcaaagcgagaagacaaaccacgctgcaatctacattggtgataataaaatcctgcaccatttatatggtaagatgagtaaggttgatttgtacggtgattactatcgtgagcggactgtgcgaatcgtaaggcataaagatttaccggaggatgctggttatgacccagaacgtgattgatgttaagttaggattaggtttaggcaggaagtttggaaagctacataaactgtgcgttaagacagttccagaagcaatgcgggccctatctgtaaacatccctgaatttaaggaattcatgcgtagtcatgttggccagaacacaaggtttgctgtattcgttgacggtaaaaatgttaacgaacacaagattaacgacctgcagactgtgcgtgaaatcaggattatgccaatcccacaaggtcgaaaatcaggaggtttattccagacaatccttggtggcgtacttctggtggcatcttacttcttccccgttcttttgccagtggctgtaggccttcttgctggtggcgtagctcagttattggcaccgcaagcgacaggattgaatgaccaggcatcacaaacaagcaacagggcttcatacgcatttggctcagcagtaaacaccattgctgctggtaacccggtttgtttgccttatggttacaggactgttggtggcgccgtgtttagcgctggttcatttgctgaagatattgtttaaaattacaacccgcctagtgcgggttttttatttagtgtagaatggcacaaatggttaaacaaacaacgaggttatatgatatggccgatttgccaaagatttatggaagcaagggtggtggcaagaagccacacacacctgtggagcaagaagataacctggtttcactaaacaagattaaggtgctgctggccgttgctgatggtgaggttgattctagcttctcacttaaggatgtttaccttgctgacgttccagtgcagaaccaggacaactcattcaactatgaaggtgtaaccgctgagtttcgcccaggcactcaatctcaagattacatcgccgggctagacggtgaggcatcagagattcaggttagtcgtgagattaacaatgatacaccttacatcatcgcagttaacaacagtcagctttcagcaatccgagtcaagctgttctggcctcgactcgttaagcaagaagagaatggagatttaaatggcacaacatgtgaatatgcaatcgatttatcagttaatggctcagcgtacactgaatataccagaggcgtggctaacggtaaaactacaacaggttacgaccgcagtatcagggttaacttaccagccgagtttagcagcgctcttgttcgtattaggaagttaacgccagactcaacaagcagcacactggttaacggaatgcagattacaacctatcaggaagtaatcgacgctaagttccgctaccctcttacagcgcttgtttacgttgagttcagctccgacctattccccaatggcatcccaacgatagctattaagaaaaagtggaagcttatccgcgtaccgacaaactacaatccagagacaaggacttatagcggcacatgggatggtacctttaagatggcgtggtctgacaacccggcctgggttttatatgaccttgtggttagtcagcgttacggattagatcagcgagaacttggtgtagagattgataaatggggtctgtatgaagctgcgcaattctgtgaccagatggttcctgatggtaagggtggaatggagccgcgatatacttgcaacgttgtaattcagcagaaggttgaagcataccagcttattcgtgacatctgttctatattccgcggtttaaccttctatgatggtgagcaaatcgggattgttgtagacaggccgcgccagccaagttacgtgttcaccaatgataacgttgttgatggattgtttaacaggacattctctagcgataagtctctttacacgactgcaaacgttcagtttgatgacgtagagaataactatcagcaagatgttgaaccagtgttcgaccttgaagcaactcgccgctttggttataaccctgtagacctgaccgcaattggatgcgtaaggcgtagtgaagctaaccgtcgaggtcgctggttgctgaaaacaaaccttcgaagtgaaacggtaacgttcacaactggcctcgaagggatgattcctatgattggtgatgtaattgctgtcaatgaccaggcttggtcaagcaactacacattgaacctttcgggtcgaatcgttgaggctactggtctgcaggtttttgttcctttcgctattgatgcggacccaggcgacaggattttaatcaacaagcccgatggaagcccggagtacaggactatcgcttcagtatctgcagataagcttacgcttgaactgaacacagcattcagtttcacgccgcagccggatacggtattcgcaatcgataagcagaatctggcgttgcagcagtatgtggtgaccgggattcaaaaagctaacacggatggagaggactcattccagtacagcatcacagctgttcagtatgatcctaacaagtacgatgagattgactacggagtaaacatcgatgacaggccaacaagcatcgttgaccctgacaggattttgccaccgcagaacatcaccgttactagctacagcaaggtagtgcagggcttaagcgttgagacgatggttattggttacgacaaagtgcagtatgcgaaaacatacaacgtacaatggcgtaagaataacggaaactggattaacgttcctgagacggctaacactgaagttgatattgaaggtatctacgctggcatttacgacgtcagggttcgtgctgtaactgaccaaaaatcagtatcggcatggtcagaaatcacaactgttagcctcactggcaaaattggagaaccatctgcgccgcctgtaattacggcttctgatgatgaggttttcggaattagggttaagtggggcttccctactgactcagcggatactgcgtacaccgagcttcagcaggttcctgataatggtgacggtacatacaatccagagaatgcatcactgcttaccctggttccttatcctcagtacgaatactggcacacaactttaccagcaggtaacgtgaggtggtacagggcgaggattattgacaggataggtaacgtatctccatggactgattttgtcaggggtatggcatctgatgatgtaagtgcaatcattggcgacatcaaggttgatatcgaaaactctgatggttacaagtatcttctccagaacgccattgatgcaaatactgacatccagaaccaggccgaagcaataattgagaacgcattagcaaacgatactgacgtgcgcgttatgaagcgcgagaatggagcaaggaaggctgaatatcgccaggctgttagtttgattgctgatgaaactcaggcgcgtgtaaatgctctcacagaacttaaagcgcagattgatgatgagattgttggtcagattacgacaattgaaactgctttagctacagagaccgaggcaagggctactgctgataccgctctaagcgcaaggcttggtgataacgaggcggctttgaatcagaagcttgactcttacgccacggtcgaaggcgttggtgttcagtacggcgttaagctaggtctgaagtacaatggagttgagtatggcgctggcatgagcatggagttaactggtagtggtggaaatgttcgcagtcagttcattttcgacgccaacagatttgcaatcagtaacggcattagttctggttccggtcagtggtcactgccttttgttgtcgataataaccaggttttcattcaaagcgctgtgatacaggacggttcaatcactaacgcgaagattggagacgcaattcagtctaacaactttgtagcaaactctgttggctggaggcttgataaggctggaactttcgaaaataacggttctacgcctggcgagggtaaaatgaagcaaactaaccagacaatttcggttgctgatgctaacggaaggcttcgtgttcagattggccgtttgactggagtttactaactgatagaatgggcaaatggaattgcccttatcaacaggaggaatttatggctgagtatgggattgctacatatgatgcaaatggtaattacaataactatgggattaagccagttacggttgttggctttgatttcctttccgctggcaataattcttactcgttttcttactcaataccagaaggcacaaaggttggattcactattagtctggatgatggggcgatatctggaccagcaaggagaatagtggcaagtgggaacacaataacgataacaccaacatcaacaccaggacctggtgtttacccatcatcaaattgctacctcatagcttatctggagaatcaataatggctgattacggagcttttatagatgtaaatggaaatccattcataacgccactatcaacaccattcgcactttactcaaaaggaacaatcgcatcaggtaatgttaacaacacccagtatgctgatagatatgttgacattcctctcaatgttccagtgatagctttttgcaaaacgacaaacacaaacaatggtacagctttgtcagcattcacatttagggagggatccaacattggaaagatctactttcagggtgttaatccagcaaatcaggcgtttgttatgacgtactacatatttgcgatattcccacagactctacctgattggggtatggctatatgggatgcgcagggtaaattgatacttacaaatgaaacaaaggttcttagcgacctagcaacaattggcacgccaggttatcaatctggtggtttaaatatagacgtaacattgcaaggaagttgggccgtggttccaacaaccctggggaatagtcagatacaaataggaacgctaccaactggtcagccagttataacaaatgcgacagctggaacatcctgcaggtacaacggagtgcagacaagaataaacgcgcagtcaacacgtggctctggaaatgtgttaagcacaacaaataacggaaatgtaataacagcaattaacacatcagcatacgactaagcccctttcggggctttttctttatcaacctccacaatcgtggtctttaaaattccgctcagagacgtactgaaacgagaatggatatccggccctaagtaaaaactcctcaccgcgcttctgcgtgccaaaaacataaacagagtaactcattccgcttgactcataaatcgccgtacaagtgcgctccggcatcgtagagcacccgcctaacgtcattgctgcgataacgattaattttttcatctcattcaccttagaaaccgttaaagtttgaagccagcagcagaacccaaacgaagaagctggtagttgctacgccgaagattgcagagattaagttagtggttaagttagtcattttgtattccttagtaagtatgtttcgtttcgatggagtaactatagcaaaggcttcagcggtagtctttagcaaatcgtgctatttgatatacgcgtaaccgatgtaactcgatgtatacaatctcatccgcggaaaattgtatacgcttttttacgcgcagatacgcattagttacatttataaatccttatataataaggttttagagtagtattattattatatatattactatgtatatcttgtaactactctctatagctatgttggtatgtttttctaaaagactatgtttgatttcctgttaaggaggaaatgcatatagatatagatagggtgcaaaattggtggatacattggttacaagagttacattcagcatccatgcggcctagagactagcaaggcgtatttaggtgcgttttacaccgatatacaaaatagcacgattaatcaaaacggctgcttcttgattgggtatagtgcactcatcggcagcaatggtgctgcgtctatctaccaaaaaatggtagatacaaatgaaatagctcctcaacttgaggagcaaggataagagagaagataatgaacttaatcaataccaagaaagaaatgaccatgacgacaactgagattgctaagattgttggtcagcgacacgataacttaatgaatgatgttaaatcaatgtaccttgagttgtatggtgaaaatcattctcctgagattcaggagattaaaattcacaacaacagaagccaaaaaattgcaattcttgataaaaaacacacactatgccttgctgcaaagtacagcgcaaaggttagaatgaacatgatcgagaagattgagagccttgagcaggaaaacaaattactgaaagagcatatggctaagatggtttcaattgacgagatcaaagtttataagatagaagctgcgtcagcaaaagctgcacagcacagagctgaagataactattacgcaattgagaagttcatgtttaagaacatggataagtgcggaaatcctgcagaacttgatgagcaatacttcgatgttaaattcgagtcaaatcgttaccatgactctcaagaggttgtttacaagtaccaggcccagcttgaggttgcttgcgagaagttaaaggccaaagatgagctgattgctaatctggtagacaagaatagcgagattcttaagttgaaatgataggcaaaaccaattggataaacttatccacggatggcatagttaaatcacacaaacaaagagagatatagaaatggcatacttcattattcaagagcgaaacaatccgattttcggcacggtatactactgcgaggatggttccggatactgcgaccacaaagctgacgccaagagattcgatactaaagctgaggcaatggaatggggcagcattaacgatgaggagctgggtggaattgttaaggtgattaaggttaaggagtaattcatgagcttcaaggtttacactaacgatgagttaaccaacgaagcctaccatgaggagtctgaccatgtgtctggctctggtctggctcacatcttctcaacttgcccagccgcatacaaatacgctgagcatgatgatagcagtaaagcgttaaagttcggtacattggctcacacgatggttttggagagctctgtatttgatgcgacatactatcgtcagccagcgcaggaagagtttgaagacctgattaccagtaaggctgcattagcagcaagactgaaagcgatgggaattgctggaacttctggaaaggattaccctgaattaatggagatactggcactgactggtgaatcactcaacgtatggtgggatatccagcgctctagcgagattaaagcagaaggccgcgagattgtatcagctaaggactttgacaccgtacaggcgatgcgagaggttttgtgtggaattcctgcttacaatgcaatagttaacagtgaaaccgctcagcgtgaactatcaattttcggtgagattaacgattgtggagtgaaggtaagactggaccatgttgatgtagttggtgatgttgtttatatccgagattacaaaacaactagcgacgcttctccgtcaggtttcggtcgcctcgcctttaagcatggttacttgttaaagatggcacttcaacatgacttatttgtgcgagcctttaatgaaaagaggcgagttgttgttcagctattggcgcaggaaaaaaagagcccgtacctaccaatgtgctacacgataacaaaagaacagttaagggttggtaggttgcaatacatgagtgcgctttctacatacaagcattgtaagaagcttgatatctggcctgggtatgggttcggtgaaacagagatggaattgcagatacctgaatatgagatgaagaaatatgaattggcatgatatttttgagtatatagatggatgcataatatggcgtgctagtggtaatgttgctggttacaaacgaaaggatggttatgtgattgtgacaataaatggtaagaaaatactagcgcatcggataatatacgaaatgaataacggagatatagagccaggtatgcaaattgaccatattgaccacaatccatcaaacaacaggattgaaaaccttagggtggttaaccaccaggagaaccaatccaataagtcaaagcagtcaaataacacttcaggggttactggcgtttggctacataagaaatctggaaggtttgtagctgaaataatggttgaaaagaagaagatacatataggctactttgatgacaagctgaatgcggcaaaggctagaaaggatgctgaaattaagtttgggtttcataaaaatcatggaaaatagcacgaatagctaaaacaacattaaatcggtgaggtatagttacctcatcgacaacgagaggaaaagtatgaataccagcgacaaaaacacaaacgttttaaaggctctatttgaagctaagagcaagtttgccaaggctgaaaagtcaaagcagaactcgcacctcaagaacaaatatgcaacattagatgacgtactcgcagctgtagagcctggattggaggatagcggtcttgtgatgttccagagcatgattgagtcagaagttgcaaatcagattaaggttgagactaagatttatcatgctgagtctgctgaatgggtttctttcctgactatcgttccgttggctaaaaatgactgccagggaaccggctcgtcattaacgtacgctcgacgctacgctattacggcagctctcggtcttagtcaggctgatgatgacggcaatcttgcagtcaagagcgtcaaggactggcgtaaagatgtggaaaaagcagagtctcgcgatgaacttgtagaggtttacaaggcttgtaaatcacaagctgatgcagcaacgtggggtattgtagagaaggccatcatcgaaaagcaggcggagattaagatggcatctgcgagcgggttcaatccagctaaaccaaaagaagtaactaaagttgttgcaaatgcaccgagtgaagctgtagaatcacaatcaatcgaacggttctaaattaaacggggcttcggccccaaaatcaaacgagaagagaatataaaatgcatactttaacaggcgtaattcgcaaagctccttacaccaaagatggtcagaatgctaaaggcaaatggaagatgtacgctatcgagatgagcgaatcctacaagactaaagacggagagcgtaaatatactaactatcgaataacgatgtttgctagtgaggcgcagattggctggtatgatgaggcatttcaggaaggaaaagttatctctgtgagtggtgattcattggtggttaatgagcgtgagcataatggtaaggtctacatcactctggagtttcagaatcctcgattaatgtttagccagcgaggtggggaatcggaaccacagcaacaacaacaacgccagcagcctcagcctcagcagcagcgacagcagccacagcagcaaagccagttcgatgacgatattccgttctgatgtaaaatataaagcccctttcggggctttttttatattgctctaacctgccaccttttatcataaaagtgagcaaatccactatatgttaatttaaggtggcaaaggaatgtgcttaccgatgcagttggtgttaaaatcctcaggaatgtctgaccaccagtcacgtacttagtaatagaaaccccatcaagagaagtgctttttgagccagtcgacttagctatcttgttataccaaggtattcctgatgagacattggccttagtgcttccagataagctaaattgaataatacctcctgattcctgaccgcctaatccattcttattaattggtataaggctcaactctccagcaataaatgttgacccatacctggactcctcaccaactgtagtaagaaggatatcaagcgccctgttataaggcagcaataaagtagcatcctcagttctgacctgattgaagtccattccactagtaacatgaacagcagataacgtagttccgttatatgagttccttgcttcaactggtgactcgccatatgtcacgttgccaactttagtgctcctcaacgtgctctttgagaatgaaccagtgtattgactgttaataatcctgaagtcatcaccaaaatgaacagagttaccttctgcagttgggtttgaaatggtgttttccataatcatcaaggcgtaatcagacttgaaataaccatcgctaaaacgtatcgatccaactggcattctactttcattagctggcaattttatcatcctaaggactccagtgttcatgcttgattgaatccagcaagaaaacccctttacatcaaatccaaactgatcgtcatcaccaccatagtcggagaaatcaaatacagtatctccattaacaccctcaaccccagcacctacgatattaacagaccttaactggccaccaatcttgtgtggagttaagcaaccatcagcagctatgtttgtcgcagtgacatacataacaggaaaaccaccagctacaggctccagggttgttgtgttaatgccgtaaccccaaagaaagccaacatcacagtggtgtgcccatacagaatcaagggcggtacttgtattacctgaaagtccaatgccgtatgtgcaatcgtacatgtatacatttgaaattttagaaacaaatgtcagtgttgataatgcatacttgtaatgataaaactcaacgttatctattgtgtactgcttgccgccaccaccttgacctgagtcatttccgctaattagaggtgagccgttataatcagcatctgcgttcctgaagccaatgtttttaacaaacatattgtgaccccaaggcgaaacaatgaagccaccattgccagatgtgtaaatcaaacacctcctaggagttgctgtaccttcaatcctaattgtctgtcctgagaacctctcaccagatacgttgacccttgttgtgccaatgtagataggcctatcaatgagaatcttcttgtttaatttgattgatgctgtgtagcacttctgcatagcaacgccatcgttagacacgccagtcaaatcagcggcgcccatgcttggtgcttttggatatggcgtaccttggattgtatttccatcaatatatggcgcgttcatcagagcaccaaacatcattggtgacaagccttcaatcaatgaaagatctcgcttccatctgtggtttccggtagtgacaataacaacaccatcatcatctgtgctggttgaatcattggcatcgtaatagaaccagccaccgccaagcatgctagtccctgagtgactagatacataaacccgctcaccgtcacgaagtggcaccaagcccctcaaaatagataagttatcaacattacgatcagcaaatgacaaaggcacccatccagaagatgaaacccctccagttgactcaggggttgagttagccgggacggttttaggaagcgcgcccgcccaaatgtaagggacagcaataccagatgaaatgtcaattacctgttgagttgctgattgaatagttacgccagactgaaatgagccaatgagagcaccagaaactgactgagctgctgactcagcactttgagcagaggatgctgcgttagatgcacttaaacccgctgcatccctcgccgcctcagcttgagataatgaggactgaacatctgccttatctgccgatacttgcaaggcatcactggcaacctgctgagactggttgtttacgtttgtgacattttgctggaatgcatcagcatcaaactgattaaaagcatcaacagctgctgcgacttcagtctcatttgactgatagtaacgcaaggtttcagcaacatcctgagcaagtccctgaacagtaatcccgtcgtgagcaagaattgagtactgagtaccagtcggagcggtaaatcccttgtcgttaaaaactcgaatttcggtatcactgattatttcagcaatggtaacaatacttgctggcgtggtattgaaaatcattgttgcgccaactcgaattagagttaacggctgcctccaggtagtaccaacaccagttacagttccgtcagctgcaagcgatgctgttcccgcgtcataaattgccattttatttctcctctttgatagatgaaacctattgtatcagattagttgtaataaaaaaccctccgaagagggtaattgttatgaatgcttatctatcagatcttgcgggttatataactttcgctcaagtcccattttgaagttcccaccgtttggaactacaacttttaggcctctatcatcagcaacgtaaagtgattcattgtcatcagggaggcaggctacccgtaattcgcgttcacctccgagataacgatacgccactatttcaagattttctggcgtgaaagtaacccaaacctcctgattggttgccaccttaacacgataaccatcaatcagatcgcttgtcatatatatagcagcatcaggctggccgcttcctagcttaacaacagagccacgcgaataatcacgcgccagaaatgtgtactcaccattatcataagcaaacatgacgttacacatttcatcatcaataccgtcagcgtgaaccatgtggcatggcaatgcatgtattagctcttcagagccatcatggcgcaatttaacaccaacgtcataagaatcttcagttaggcactcatacacgcttaaatcggtgttctcgcgcttttccgtacgctccattactgctacacacgattcatgatcagccatcttacctaatcctttttcaggtacgcgtgacgccctgcgataagcccttgccttgtaatcctgcggaactttaccaaggaatcgaccgagaatgttaataacctcactataaggttctccagtcaacttcatcatccagccaacaccagagtcgttaccgcattggttacagatggcgccaccgtcaccaggggagttaatattgtcagtccagcggaagcggtcttttcccgagcagtgagggcatgggccgtgctttttgctaaagtatgaatcattaagcccgcatatagattgcagcgcctccctccagaggcctttcatgtacggaagaacctcttctttctggtaacttatctcgctcactgtatttactccaataaaaaaggttgcaccgattatggcacaaccttaatttttactctttagcttttcgtgctgcttcattagctgctttaattttacgccaagagcgacactctggtttggtagctaactcagcatcagtaaccacgcgcagcatgtgacgcttcttgcagcgcagagtaagtggcttgccgttaccatcaaattgaaggtctggacggcagaatgtagcgcggaacccttcgccagttcgcttgtatcgattgtgagcaagctgggcgccacgtgccgacatcatgccgcgattaaaccactcctcaacagcctgtcgagtaacctttaattgcttcgccatattagccttgctgccgtagaagtctaaaacaatctcaagcctcgcccttaaacccgctcttacttcatcctttaacacatagtaacctgacggtcgtttgcgaggttttttgtcttctgttcgtattgttccgttattaccgttaagggtacgcttatcaatttcacacacttttatcacctcgatagcactttttgttaaacattgtctttgatggctgttattataacgtcaatcgaacgaacatgaaaggcatttgagaacatgactatgcgattgaaatcaatacaaaaacaaattgaagaactaggcaaagataagattaaagagattcaggaaaaattcacatcatcaaatggcatggttccttacagctatcagtgcgtgatgtatgacgagatcgccaagcgcattggtaaatataaatacccattcatcgctatggcttcagtatccgctggtaagactctggttttcgccatggtcgcaaagcgttgctctgaacttggtttgccgatgcttttacttgcgagacaggctgagcttgttagccagagcgcctctgaaatttcagactacggcgttcctaactctgtctattgttcaggccttggcattaagtcctcttatttccctgtaattgttggctctgaaggtacagttgttggtggccttgataaggcgcttggtgacttctgccccgcagtagtcgcaatagatgaatgtcacatggtagatgaccaggatatcgctgaagcaatagacaacaatgagacatctcagcaagcgagagataaaggacgaagccagtacacaataattatccttacattgatggagagatgccgcgctaagtatggtcgtgaattgagaatatttggcctgactggttctcctttccgcgggaccgcgccaattgttgtagagaaccttaaggaacttggattctggcgtgaagcagcgactaacattgataccaactatctggttgagtttggctctgttgttcctacaaatttcgggtctactgatggtgttggctatgacctatctgagtttgatacctcagctgatgatggtgttcaggacttcactaaatcccagctagaagcaatggagaagaagattcagcagtcgggcacaatgacagctgagattatgaagaaggtgtggttggcagctaaagaacgaaacggtgttctcgtgacgtgcgctggtgagcgccattgcaaggaggctgcaagctatcttcctgaaggtgaaacttactgcataattactggaaaaactggtgagaagcagcgtaaggaactactggataagtgcttcactggagagattaaatattgcttccaggttcaggcgcttactactggggttaacgttccaacatgggatactagcgtaattcttcgcaagattggcagcctaactcttctagtccaacttctaggtcgtggaatgcgcaaactgaagaagctacatgaagacaagggaatggttaagaatgaccatttagttttagatttcgctggaactatggactcgatggcttcactgtacttcaatcccattcttgagcaagctcagtatcagctacggaagagtaacggcaaggagactaagcagtgtccagtttgcggaactgagaacagcttctttgctcgccgctgtatgcatgttgacgaaagcaataatcgatgtgaatacttctgggttagtcgcacatgcgaagaccagaaagaccctcgcactggtaaagttatagttaaaggatgcggggttcagaatgacgttgcagctaagatttgcaggggctgtgattgcacattacttgacccgaacctaaagttaagcgggaaacattacagaaaaaacgattggtttgacgttgttgattttaaggttggactaacaaagaaccaatcaggaatcatctataactatgtgcttgatgatggcatgggcggaaccttcaaggcttatgaggttttcttcgtagagtctgaccatagagtatgtaaaactctctggctgaataatggaattaaaggtcacgtagttgatatgaatgccaagcgatatatggctgcatatcgaaatgctcgcaagattatggagtacgcgcagtacattcaggccccgaagcgagtaacacaccgcaagaccgctaaaggcggagataacatggcaaataaggagttctgatgattaaggtattttacgataagacaagcacggacaaggccaaagagtttgtacaccaggttaactgtatcgcatgggttcgccataaccaccctgagatatttgcatggcacgtgaagaatgaaggcttaaagtcaatcggcactgcagtgaaggataagcaggagggcgtaatcaagggagtgtcggatatattactgatcgggccaaaaggatttggagcaatagaacttaagcgagcaataaaatcagatagcaaagtttcgaaggagcaaaaggagtttcttgaaaaggtatcagaaacaggcggttacgcagcaatctgctacggattcgaaatgtttaaactggcaattgaggattatctatcaaatagcacgaattgctaaagacgaaaaccaaggatggtgtattatcacttcatcgaaacgaaacgcacaaatgaggcaaacaaaatgaaaaagttaattatcgcaactatcctgatggcggcagcaagtgttaatgcagacgcgaaagctaacaactgtcatgacatcgttcagtacgcttacaaccttgcagttaacgaatggggcgctaacaaaactgatgtggttaatgctaaaactgtcagtctctacctggatacatgtgaaattgctatcaaatcacgaggcacttacactaaagatgaacttacagctaagtatgattcagtaaaaacaagcactaaatcagagatggatgttcaggatattgtaatccttgtatctagaatctcttacgataaggcataattttatgaaactttctttagaaacaaagtgggaactgttccagggattagcagcaaagaagctggttgataacggatttaatcaagatccttttgaaatggctagcagtctagatatgagctttgaagaagattacttgcacgctgatttagaggattgggaagatatgatgcaaggtaacattgaagagtttaaagaggatgtgcctgaactttttgcggagattcactaatgagtgaggaacttaaagtattctataaagcctatgccgcttggcttgacgctggcgctgttaacaagggtgcattctggcgtgactgtggtttgtgtacgtgtatcgtgtcttggacgaacgacgatgaaggttatgagttactgaatgaaatgaaatcgcagtttaccgccgctggtctgagcgatcgattcccgttcaacgttagcgacgaggattacgcccgggagcatctcaatagcgccatgcaccttaacgaagaccgcgtagcctgggtacgcaaacatgtggagatccactaatgaagattgatagaaagcaattctcaaaagctcaaattaacgcatggattgcaacgcagtttaataactcagaacattggattaaagcaatcgaacagcttaggtgtgcttatgatactaaaaaccggaagggctgaggtctggaagcactgcggagaggctggactacaggatgatatcaagataataagtaagtactttgacattgatgatatctctgtagtttatgatggaaaattcagctatatgaaccagcgccctcgaaagtatgtaagagttccggcaaccccaagccttgcgatgtatcgcgaggaaggtaagaagatatttaagaaaggtgctaagaaatgaatttacctggacttgattttgatgagagtaagtatccagttgtcttttttggtgagaagccttaccggaagatcccttttgctgattggattccaccagactatcttgatgtgctggttcagattgaagttggtaaggctgaactcatgtattactcaccaggctgcaacatgatgatgcctagtgaatactctccggcaatagccgcgcttgaaactgagtttcttgattactggctaaaagaagttaaatagcactttttgttaaaacgcaccgccaaggatggcgtatagtgtgttcatcgaaacgagagaagctttagatgaaaacattactaccgttgatggctatgccattaacctttataatcatgtacttcataatctgctaacaggaaattaaataatggctattgctaaaattacgaacgaacaacttaaagaagaactagctaacggtatgactaacaaatcaatcgcagagaagtacggtatgaatattcgtaacgtagaactgcgtcgcagcaagctggctaaggctggggatggtcacggtcgcgatgttagtaacctaattcctcaaggctacatggttaagggtgtatctagcctcgttgataatgatggaaatgtaaagttgcagtgggttaagtcctccattgatgcagaaaagcttgaagagattatgaatcaagcgcgagaggcattttctagtgagttaccaaaagaaaaagcagtgaagtctgaaggtctggattttgatgaagatactttagccatgtatccagtgtttgaccttcatattggcgcgatggctcataagcatgagtgtggagaaaactacgacacagcaacagctgagaaagtaatgaatgactactttgattacgctgttcagaaagctccaaattcaaagaatgcggtactagttcttggaggagatttacttcactatgattctctagaggctaaaactccagctagtggtcacatccttgatagtgacagtcgctacgctaaaattgtttatgtttgcatacgttcggttcgtcgtgcaattagaaacatgcttagcaaacatgaaaatgtagaggttaaagttatatccgggaatcatgatgaaagtggtatggtttggttgcgagctgcacttgcggcattttatgaggaagaaccacgcgtaagtattgatgttagccccgcggcaatgatggtaactaagtttggttctacaatgctcgggttcactcacggccatcaaatgcggaaagctgatactcgccttacggttatggctactgactggcgacgtgactttggcttaagtgattatgtatacacccactcaggcca

SEQ ID NO: 14 - DNA, 48988 bp, Unknown
  bacteriophage genomic DNA
cgcattatggaagtaacgggaacgcaggttttcttggctttccgctgcgacgcgaaggcgggcgatacgctgattctgaacactgacgacggcaagccattacgccgaaccattgctagcgtatcagcagacggaaaaaccctgacgctaaacgtgggatataacttcgacgttgcgccggacagcgtattcctgatcgaaagtgaccaactggcggctgaacagtacgttgttaccaggattgagaaggggagcgatgacgacgaatttactttcgccatcacagccacccaatacaacccgaacaagtacgacgcgatcgacaacggcgtaatcactgacgaccgcccaacgtcggttgttgacccggattcaatgggagcgccggaaaacgtgtcgattagttcattctcacgcattgtgcaggggatgagcgtcgagacgatggtaatcggctggtctgccgtgcagtacgcaaaactttacgaggtgcaatggcgtaaggatggcggcaactggaacaacgtgccgcgcacagcgacaacgcaggttgacattgaagggatttatgctggcgaataccaggcgcgcgtaaggtgcattagcggcggaaatatcgcgtctccgtggtctgctttggctagtgcatcgctgaccgggaaaattggagcgccgaaagggccaattaaccttttcgcgtcggataatgaaatctttgggattcgcgttaagtgggccatgcctgaaggtgcagaggatacggcatacattgagctttaccagtcgcaaagcggaaccgatcaggatgcaagcctgcttactctgattccttatccggcggctgaatactggcactcaattttgcccgctggctatgtgaactggtacaaggcgcgaagtgtcgacaggatcggcaacgtttcaccctggactgattacgctcgcggtatgtcatcgactgacgttagcattatcacagatcagatcctggatgaaattctggatagcgacgccatgaaggaattgcaggagagcgcacaggacagcgcgtctaaactcaacgactacgcgaacagcatcattcagaacgcgttagccaacgatgcagacgtcagagttatgcgcaaggagaatggcaagcggaaggcggaaatctcgcataccaccgtgctgatcgctaacgagactgaagcgagggcggctgagatcacacagcttaaaacgcagattgatgaggatatcacgtcgcagattacgatcctgaacgaagcgctggcagatgaaagcgaaacgcgagcaacccaaattaaccagttgcaaacacaatttggggaggatatggaagcagggtttacgcaggttaacgaggcgatcgcaaacgaaagtgaagcgcgcgcaacgtccgaggcagcgttagatgccaaaatcggcgagaactccgcagcgctggcgcaaaagctggattcgtgggccaatgttgatggcgtaggttccatgtacacaatgaagttagggctaacgtacaacggacaggaatataattccgggatggcgttacagcttaccgcacaaggaaacaacgttgtttcgcaagtgctgtttattgccgatagatttgctatcatccgcaatgcggcatccggcgcttacacgcttccgtttgttgtgcagaatgaccaggtgttcatgaataacgcgctgattcaggatggctcgattaccaacgccaagatcggacagtatatccagtccaacaactttatttcgggccagcaggggtggagcatcaacaaatccggtgcgtctgaattcaataacgttgtcgttcgtggcgcgctgtttgctgcgtctggtaacttcggatttgatggcggaaacggtgtggtaatcaacggtaacggcgtcaccgtcaaccttgacggcggcgggcgaattgttttagggaggttctaatatggcaagcggtttacttatcgatctcaatgatggtaatccggcgatgcaaatcacggcgggcatgcgttgcccgtctttttgcaacctggttgctaacgcgtgggatgagaaagtggttaacgtggatggatatgtgccaggggcgcagattatcgtcatccctcgcgatccagtatccatccagaacagagggacgaaccttgttccaactatcgggatgcaaagcgggtactcgcagaacggttcccagcttacgttttctacgtggtggtcagataattgggggcgtgaccgcctctatgatttgacaatctgccagatcctgccgtcggccagcggccaggggttatacattgccgattccaccgactttacggcaatccccgattcaacgcgggccgggttttgcgtgtgggccggaacgatcacgtttacagggcaatggcgaactcccgataccggatacgaccgcaataagtatatggtgtttgctcgctggagcgccgacggcgtgacggtcgaatatgacggaaataacatctacgccaggaatgaaacgaacggagacgagggcgacgctacggttacaatgagggtggcgattttcgccagcggagttgcgccacaggcgggaaccggattgaactttttcaacgcggcgggccaatgcacattctccacggttcgccgtccgtttatcttcaggaaccgattctataacccgtcgtgggattatcaggatatcggcgcgggaatgattttgcttggcaggtatggattcagaagccgggtaagtggtgatcggtgcagggcaaaatttgccgggttaatgatgagcggtaacagcgtaagatgtgccagcggcatcacaaaatctaactggacgtcaagatatagcgtcgtccaggatcgattagtcggaatgagcgttcccattattgaaaacatgtattaaaagaaaaggggccaatcggcccctttgttacatcccaagtttctcctcaatggctgatagccgcgcctcgaatcctttcgcaataaacatgtttaattcatcgagtcggaacgaataacggtcgccagccggaataactttgtagatcgggttctctgtgccgtcctctttcgccgggccgtagtggtcaacaacggttgtttcttcccacttgtcgtaacagatgaaagcgtaatcgaaaggctttaatccgtgactttccataatctccattgcgcgctgaaccgttaacccgcagtgctcgcggacgtcgttcatatccgcttgctccttccacgtccaaaaaccgatctccttcgcaatttccttcgccgcttccgtttcaggatccgccatcattcgaacgtcatttttcaaccgtgcatcggaagtgttgattgttccgtttacggcgtaaatgttcattgcccggccagatccccggcctaaattgtatctgttatccgcagatggcgtaagcgtaccgttgtggtcaaccatccagcgaggagttcggccaatcgatcctgtttcgcacgtttcaaatacaacttgcgttggagttgatgttttaccccacccagcagcggctttaatggaaactgaacccctcattgaatcaaatttctcgccatcatgacctgacgcgccgatgtagaaagtagatcctggctgtgccgcaccaatgtatcttgtggtatcggaaaggctaccgtcgcaccacatagcacgaattgctggcgatgatgtggcggaaccacgcggggcgatcatgttaatttcaggagcttcgcctcctacaattttcaaccctcgcccgtcctggttagtcggagcattaaacgccggaacgactgcgttcaacgtctcaaagctacgcacaagcccaagatccgggtgcatagagccgtcgggaaccagccaaagatcgccattatccgacagcctgaacgccggaaccctatcgctaatcgtcttacctttaggggttacaagcaagcgaatccagccgccgtgattggttccagatgtatcgccagcgccaaggaaatgcaaggccgcgttactgtgctccgtgtagtcagatcctaaccacgggcgagaaccataaccacctaaaagctgattgttcttagttgcgctattggacgcccctcgcgcatagttatggaatacagcagatccgccagccgtattctcaatcccgaaagagcattccgttgcgttgtcgccgataaagttaacgccaactccggttgtcgcggtcgtctccttcagtggcaatttctgcgacgcggtaacatcaacaccgccgcgaaggttggatgcaccattgacgcggagcgtgcttaacatcgtaactgcattgctgaaagtcgcattcaacccggtaacggtaaagtttgccgcatcaaaaacaacctgcttcgcgctgttcatatcgccattcgggcggaagtacatgccttgaccgtcttccgggatggagtaaacgatcgcgttgttgttattggcccgaactacggcaccgttcagggttagcgtagcgttaccaccagggacggagatcgcttgcggctggctgaacgtgttagctacgttggtgcgggcaaccgtattatcattagataccaggtaatcagcgggtgaattgtatacaatccccgttggctccgttgtaatccacgtgtagccagcgcgatcgataatcggccctgtaatatatgagtttccggcctggatgtttacgcgattcagccacaggttaggaatgtaaccaccgggagagtacaaataaacatcaaacgttccgttatcattcttcaccacgccaaggctaatgcgttgagatccaggccttccgctaatcaaagcgcgctgtgtaaaccacgtatcaatgttgtcgcttgttaatgccgactccggaagacccctgcccgaaatggagaagatatcgaccggaacgttagcagcgccaaatccagccccgccgccgataataaattgtgcaaagcaataagattgcccggcatcttttacggtggcgatcttcatccatgctttaccgcttcctctttcactgagtttatcgggagcttgcacgccagaaacaagatctactgtgttgtcatagatctgctgcgtgttcgcttgcgcttgctgtgctgctgtttttgacgccgccgcgtcagtctgagaagccgccgccgcagcttgcgatgatgccgcagcatcttttgacgcttcagccgccgccgcgtttgtcgctgatgcttctgcgtccgccctgacctgatcggccaattcctgcaaagcattgagatcgaaatctttaaagaattccaacgcttcagcaataacagtttcttgcgattgatagtagcgcagcgtttcagcaacatcttgcgccaggccgtcaacggtcagcgagtcgcttaaaaggatcgcgtaatcgctggacgggacaaccgcgccgtttgtggtgatggcgttaatttgcgtatcactgacaaccttgttaatcaccgccatttgaatcggcgacgataaaaacatgattgttgagcctgggcgaatgagcgataaggctgattgccacttcgtgccagtcccggtgataacgccgtttgcgtccatcgcggctttgccttgtctgtatagtgccattttaagacctcttttggttggttgagtaacgcagataatagcatcaatgaagcaataaaaaaaggagccttgcggcccctttggttgtcaaatcagaacgggatatcatcatcgaaatccatgccctgattaccaccaccgctttgcggcttcggttgttgttgttgcggcttcggttgctgaggctggccccacccaccctgctgattaccgccgccctgcgttggttcgcgctggctgaattccagttgcggcataatcatttcattgtggctgtaagttgcgccattgtgctcgcggtttacgatctgaagtgtccggcaggttacgctaataaccttgtcgacctgcaacgcttcatcgtaccacgcaatcatgctttccttcgcgaagaagacggcgcgatagttggtgtatacagtttcgtcctggccgtcgcgattgcggatcttcattcgctccgacaggtcgaccgcatacatcttccacggcccgttattgttgctgccctcttttacgtaaggcgcttttcggattacccctgttacaacatgcatttttattcctatggggcggtttcccgcccggttaaattagttgaaagatgagatatcttgtgcttcaggttcaggctttgattctacctgttccggttcacgtttcgcaacctcttgcggctttccggggttaaatccgttcgctggagtcacttttagttgcgcctggcgcttcgtgatatcgtcttccgtaaccttccattccgcaggcgtcaacgtctgtttagccagcttgtaaatctcgcggagagattcgaggtcttcgcacgcatcaattcgttttttgaagtcttgcggcttcatcttcgcgatctctgcgtcatcgtcggcctgcttgatacccagcgcggcggctaacgcataacggcgagcgtatgaggttgtcgaaccatacgcttgctcaacggttttactgatcggcatattgaactgaaacgccatccactcgccagattcgtgcaggaacatagtttcaaggtgcataaccttgtcggtgctggtatccatcattgattgaatgaccataattttgttcttttccagcgatggcccgatggcgtccaggatatcgccgagattggcgtaggtgttccccaggtggctattcttcccgcttttctttgcggcgacgaagccagacttcgctttgattaacgcaacggagatctctttgaaactttcagatgtacgcatgacaaactttccttttcctgattggtggagcgcactatatcacaagtgcgccgtggtgtttagctatttgtgccgtatacttccgggaacatgtatttcacgaattgcggcgtgggcaacttcacttccgctgcgttcgattcgtatgacggccaaacgtcatgcttgacgcattcggcgtactggtgaatcacgctttgatactgcttccgcccgatctcaatctgctgatccgttaacgtgaacgcgagaggcgcgaacggtgattttttctcctgcgtcagcaggcggacaacaaccgggcgtttttcgttgtacgtcttaacgaacagatcgcgctgcaatgccattttgagatagtagcccaggttgaacgccagccgcccgaagtcatccggtttagaggtctgagtagttttgtagtcggtaatcaccaccacttcgaaaacttcatccgggttaaacccccactctttgatgagttcgggatccgacacgacgtcaacatgatcgagtcgaacctttaccgggacgccgaaaatttcgccgaagattgacaactcgcgttgcgctgtatccgattcaatgcacgccgcgtgccgtgggttagccagcatcacgtttcgcatttgcacgaccgcatcgaaatcagaatccttgaccagcttccggcctgagttgatggcggcgctttcgtcgcagagctcgatcgcccaccacacgttaacatcaatcccggcgcggtatgccatttccagcaattcggggtagtccttgttggacgtcccaatcaggccacacgctttcaatttcgcagacaatgccgacttcgaagtaatcagatccttaacgtcgcccggcgcggtcgctcgcaggtactcgccattaaatttggacgtctcaagcatgcaggtatgggagcaagtgccgaatgaaagcgcggctgtttcttctcgctccttgtatttccagtgggccggggatgttgcgtaaatctcgccgaggcttgagccgctaacgtatctggcgcaccaggagttaggatcgtggtaatcatcgttggataattccgcgttggtgtatgccttaaaaattgcttcagccattggtatcactccgtttgtggtttcgttgcgttaagtatacgcatcacgattcaaggtgcaaggcaaaaagtgctattcgccaactggtcaaaaaatgagcgaaatttacgtaagatttagtaagatgcatcttacttgattttctttatatatttcatgcggttaacccaaatcggtaagatggtaagatgcctataggtaaataggcacaggaaaattgggccgaaatcgcaaagcaaaatacatatacccggagaaaatcttacctacacagatagatagagagagagtaataataataatatagttagatatcatatacttatatatatcctatggtgcgatattggtcaaaaagtgagcgaaatttacgtaagatgcatcttacctaatcttacttaaagtggtcgaccagttggtaagtcgatgaattttgggcataaaaaaaggtaagactgaaattatcaatcttacctaaaatttgttcacgttttaatcagagaagggatgatgccacgtagagctttcgttcaaatccgcctttgaagttgtcattgttcggcacgataactttcatatcgcgttcttcagccgccgccagcatatcccgatctttcctgctgcatacgactcgcaattctcgcttgccttcgccgccgccattccctttatatcggtaggccacgatctcaacgttggacgggatgatgcatgcccacacatcacacttaaacgagcttgcgatattgaagtgcatcgcctcaacccaagagcgagccaggtaaatcggcccgttaccgccttcgctctgattggttacgatcaccgatccgaaagtcaggtcgccagctaacatcttctcccggccctcctcatcaatgaataagatgttgcagtattcatcgtccggcccgtcttcatgcaccagttgcatcgggagcgcatgaaatagctcttgcctgccgttctcgtgggtttttacgccaacccggtatgattcaacgaactcattttcaatgccctcatagagcgttacaggcgtgctatcgacggcctccgttatgttcattatcgccacgacgcgatcgtgatctgccatcttgccatagtcgtacccgttatcgcgagtaacctgcttgttgcgcttaactacgtactcttgcggaactttgcccaggtatcgcccaagaatgttgatgcactcgctatacggctcgccgctcaacttcattaaccatccgatccccttatcggcaccgcagccgctgcaatatgccccgccgtcgccgcgattctctaatttgtcagtccagcggaagcgatccttaccgccacagttggggcagtcctggtgtttgccgttgaaatagcgggagtggatgccgcaaatattttgtagcgcctcgcgccacatccccggcatgtatggcaaaacctctttttcgtcgtaaaaatccacgtcataacctccaaataaaaaacgcccacgcgagaatcataacccggtaggcgtttagtagttagtcaaattgtgctatcggactacgcgaagcatttcgcggcggtcgcagcggcgcgtaatcggcttgccgttgctgtcgaatctgagatccgggcggcaaaatgaagccctgaagcctttgcagtcattgcggcggtaactcttttgcaccaggtaagcgccatcggctgaaatcatgccgcgcttaatccactgctgaacaacctggatgctaacgcccaactcctttgcggttttggcgatgccgccgtatgcctcgatcaccaattccatccgggtagtcaggcccgccctcacttcatccttcaggacgtaatagcctgtcggcttcttgcgcggcttcttatccttcccgcgtgacgtcccgttattgccgttcaaagttcgcttgtctacctttgccatttgttccataatttaacctcatagcactttttgttaaacacgataaaatgtgctctgtattatacacgcaactatgcgaatgacaaattaggattactcatgctcacaattgaacaacaaattgaagcctacgcagacaagatcccctccattcaaaagcggttcacggtcgggaatatcgttccgtacccttaccaggctgtcgcgtacatcgagacggcgaagcggatcgcgaactatgagcatccgttctacattaaggcgtccgtatccgcaggcaagacaatcatgatcgccatgctcgcggcgcagtgcaaaacaatgaacttgcctatgatggttctcgccaggcaggccgagatcgtgaagcaggattccgaagaaatcagcaatcttgacgtgccaaactccgtttattgcgccgggttaggcacaaaggcggcttactttccgatcgtcgtcggctccgaagggacggtggttaatggcctgtttaagatgctgggcgattacgtgccttcagtcctggcaatcgacgaatgccatcaggttgactggcaagatctcgcagaagcgatcgcgaacgatgaatccttcgagtacatgagccgcgcaaaggataagccgtatcgcgtgaatggtgagatcgtcgatgccgattacccgtacaacgaaaagttcgaaacggttgaatttggtggcgggcgcactcaatacaccatcgtaatcattgagttaatgcgccgttgccttcagaagacggggcgagaacttcgcatcgttggctacactggttcggagtttcgcggcgtcattcctatcttacaggaagacaagagccagcctggtttctggcgcgagcagatcacggacattaacacaaactaccttgtcgaattcggttcggtggttccgacaatctttggtgacactgaggccgacggcctgggctatgacctgtcagagtttcacggctccagtcaggacggcacgcaggattttagcgcggaagacttgcgcaagatggagaagaaaatccacgattccggcgaaatgactaagctgattatgcagaaggtggtcgagcgtgcgcagacgcgaaacggcgtgcttatcacttgcgcgggccagcgccactgtaaggaggcggcgagctacttaccgccggacgccacatacgcgatcatcacagagaagacgaactcgaagaaacgcggtgaaattctggacaaggcgaaccggggcgagattaagtacatcttccaggtgatggccctaacgactggcgttaacgttccgttttgggatttttctgtaatccttcgcaagatcggttctctgacgctgctgattcagcttttggggcgaggaatgcgattgctcaaagactggcagaaggaagcgccctattcgtgggtgaaagaagatcaccttgtctgggattttgccggaacaatggatgacctgggccagttgtatttcgatccgattttggagcaggcgcagtatcagaagcgcaagagcagcaagaacggcccgaaaatttgccctatatgtaagggagaaaatagcgagtacgcccgccgatgcatccacaaagacagcaacggcaatcgttgcgaatacttctggatctcgcagcgctgcgaagaccagaaagacccacgaacagggaagattaaagtaaaagggtgttacgctgaaaacgatattgttgctcgccagtgcagatgctgcggggtgcagcttaaagaccccaatgacaatctcaccgggaagcactatacgcagaatgactggtatgatgttgtcgggttcgatatcggcttgactcgcaatcagtccgggatcatcttcaattacgtgttactgaaccatgacggcgagcgattcaccgcaagggaaaagttcttccctgaatcagagaatcagatttgcggcaagttgtggcggcaaaaggcagtcttccagcacgttagcgacgcggtaatgcgcggcaagttgggtgggatgaaaaattcgcgaaaaatccttgagaatgcgcattacttccgagcgccgaagcgcgtaacgcatcgagttaacggcaagaaggaagatattatttcaagaaaggagttttagcatgaacttcaatagcatattgaggtacgaatcaggcaagctattctggactataaagccaagcgcaaaggtttttgtaggagatgaggccggatcaattaatgatgaaggatacataaaagttatgtataggcgcaagagttacccagcgcaccatatagtgtgggtaatgcataatggcgagattccagatggctatgaaatagatcacgagaaccatattagaagcgataacaggatcgaaaaccttagattggttacgaggttggataacatgaaaaacaaatcagcatactccaacaacaagagcggggttgtaggtgttagctggagcaagaggaaaaacaagtgggtgtcgcaaatacagcacaaaggaaaaaagaagatgctgtatgaaggctcaagttttgagtacgccgttgcagcaagaaaggccgcagaggctgttttaaaatttcacgcaaatcatggggaaagataatggaaatcactgataaaactgaataccttgagtattacggcggggcggcaaaaagctgccctacagaaaaaattgaacacattaactgtgtatcatggctgaagcacaaccaccctggagttctatttttccacccagtaaatgaggggttgaaacacaaggccagtgccgttatggatgcacaaatgggattgcttaaaggcgttagcgacttcgttatcctgattggtttcggtggcaaatacccgttcgcagccattgagctaaagcgacagggcaaggcgcaggcgtcgccagtgagcaaggagcaaagggaattccttgctgccgtccggcgtcgcggcggattcgccgccgtggcctatggattcgagcaattcaagatcgctttctgcgatgccatcaaatagcactttttgttaaaaccgcccggcgaaagccgggtattattaccccatcgaaacgaagaacggagaaacatcatgaaaactttattagtcgcaattgtcgctgtaatcaccttgtccggttgcacttcatcaccccgccccgatggctggtgcgcaacctcaacgcatggaatctgtgttgccaaatggaaaaacggcgtagttgttccggctggtgaagtcgatgtgcgcttcgctggccttgaaaagaacggtaacgagatcagtggaaccgtaaccaccacaggtaatgaatggtaaaatggcaaaagatatcacagacaaagacattcgtgacgcattcatcacgtttgagcaattggagcgcgaaaagtttattggcaatgcccttgctactggcggacactatcaggctgtcaggcccgacaagttttaccatgtaacaggcaaccgatacgcctggagcaaaacgcctgatatcgtgcgcgataagttggcgaccgatcgcagtctaatcgcatacatggaagagcgttatggcccttacgatcttgacgcagcggcagaccaaagcaacgcagtttgcccgaagttctacgacgaaaaaacggattgccttaaacgctggtgggggaaaaacaagcacatttggctgaatccgccttactcgtttccagatccgtttattctcaaggccattgagcaaatggagcacgacaaccagatcgacattctgctacccggcgacaattctactgcctggttccgtgacgcgcagaagatggccgccgaaattatctggattgttgccgatgttgaagaggatgatgacgggaaccagttaagccgatccggtcgcctcgcttttatcaacggattaagcgggaagccagtcgacaacaacaataaaggaagtgttattttcatcatgcgcaagctcaagcctggagaggagcaaaaaacgctttatattccggtaagcgagatttgcccttcattagctaaaaagcgtatgcgcaaacgtgggatctgaaaaatggaacagatagaatctttcaccgagtatcttcggatcgtggttgaattgctggacaaatacggcttcattgggacggatgaggaaaagttagcctttgctgacaccatcgacggaacctacctggagttcatggacaacggaacccctgtcgctgactggccagaaattcttgagcgagaattgattgagtttaaatctcatgaaggcgcggagtatttcgaaaaacagcactaattgctaaacaatacccgccgcgtgcgggtattattaccccatcaaccaatcaggagcaaacgccatgaaaaccaaaaccattgcagacaccataaagatcgtaccagcaaaagcgcaagttgtatcgcgccacctggttaacctgtctcgcctgtgcatggccgactacatggcgaacccttcagataatggccttgatggtgaaatcggcgcgatctacttccgagccgcccacggcatcgaagaaattcacatgtacgagcagatggctgaatgcttctgcatttacggtgacgaataatgattgtcgaatctggccgcgctgccgtctggcagcatgccaaagaggctggcattagtgacgatatcgttatgatcgcaaagtatttcgatatcaaggatatctccattgtgttcaatgggaaatttacctatcttcatgagcgcccactgaagcgcacgcgtatagcggttgcgacgcgagcggaggccgacgctctgaagatgttcattaatgagtcgaagcagaccaaaaaatattacaagtagcgggagtgttgagaatgcgatatattgcgatcctgattacggtggtggttctcactatcgcaatctttaactacgcaattcaattgggataaattatgcaacctaaaattacagacgaagaatttttagccgcccgcgaggaaggcaagacctaccgcgagatcgccgaagagttcggcatgaacgttcgcagtgtggagcgtcgcggcgttcgacttgcccgccaggggcatttgcacggtaacaaccacgtagcgaagcacatcccggacgggttcggggtcaaaggcacatcgaccatgattcgcgcgaacggtgacgaagttgtgcgctgggtcaagtcagaagtagaccgcgaccgcatgatcgctttgatggaggcggcgcaagcatcattctgcgaagacctcccgcgcgccgaaccgcagccgaaggatgaatcgaagtttttcattgaggatcagcttgccctgtatccgatcttcgacttgcacatcggcgcgatggcccacaagcacgaatgcggcgagaactacgacaccagcacagccgaaagggttcttaaccgcttctttgactattccgtttcggttgccccgcagtcgaaaaaggcggtcttgctggtcggcggtgacttccttcacagtgacggcctggacgcagtaaccccggcaagtggtcacgttctcgatcaggatagccgttacgcgaaacttgtctatgtggctattcgctccttgcgccgcgccgtgtcgctactgctgagtaatcacgcggaagtagaggtgcaggtaatcgaggggaaccacgatcaggctggcatgatctggttgcgtgcagcgctcgcagcgttctatgaaaatgagccgcgcgtattcgttgacgtcagccctgccattctgcatcgcaccgtatggggcaaaacgatgctgggctacactcacggccacacgatgaagaaggcagaaacgcgcctcgccgcaatggctactgacttccgtaaggagttcgggcaatgcgactacatctacacgcattcgggccattggcatcaccagaccgtaacggagcactcgttagggattgacgaagtacacggccagttaggggccaaagacgcttacgccgctcgcggtggttggcgctcctatcgccaggcggcggttattctgtacagcaaagaatatggcgaagtaggccgctttatctaccgcccgaacatgtaaccacaacggccccgcgaggggccaacaaggaaaaccgatgaatagaaatatctgcattttcgatctcgatggcacgttgtccaatggcaaccatcgtttgcacctgctgccgaaaaaagatctccacctaaccgaaagctggacggcgttcaacatggcggctggcggcgacgctcccattacggacacgatccggttaatggaggctatgcgcgcagcaggatttatcgtcatcatcatgaccgggcgaagtgatgaggcacgcgagatcactgaaaaatggctggtgcaaaatggcgcatcgcattacgacctgctgattatgcgatccgcctccgacaaccggaaagatacggttatcaaagaggaaattttacgcaagattggcattgagcgaatcgttgcagcgtgggatgatagccccactgttattgcgcacttccgtagcctgggtatcacaacttaccaggtctgcgactacggcgaaaaccttcacgaccatctgaaatctcatggagtagacaaatgaaaaatgtaatcatcctcaacggagcgcctggcatcggaaaagacaccatcgcggaaatcatcgcccgcaaatgggagtatcggatcctgagtttcaaatcaccgatgtttgacattgcgcgcgccatcctgggtgcaaccgactttgcccgcttcgccgtccgttaccacgaccgcagccggaaagaagtcaagtgcgactttttaggcgaccgctcgccgcgtgaattcctgattcacattagcgaaaatttcgtaaagccgacgttaggcaaaaagcagttcggcaagttgctttgcgattccgtcgtgaattcgcctgttagttgcgtcgtcagcgacggcggatttgacgaagaagtagagcacatcgcggcgcatgatagcgtaaacgtctttgtcgttcgcctgcatcgtgacggaatgactttcgagggtgatagccgcaagcatattagccgcccggatctgatttgcgaaacttatcacgaattcgattttgatatgacgactggcgagccggaagacgacgcgcaaaaaatccttgatatggtttttgaagggtattaatattctctacgtaatgcctttattatcaccgccttaaactttgggagccttaacaggttcccttttttttgttctttatttggcccaacgcatatatcatcgcattatcacttaactaacagaggttgcatatcatgcgggaattcatcaacgcggcaaccaatggtagcggcggtgttaccctcgcaggctctgcgaccgggcaacttatcattgcggccattggtttatttttcatgattctattcggctccttcggcgcgtggttgcgctggcgagattcaaaggcgcttcgtgaagcgctggaagccggggatatcaaaacggcggtgaagatcaggagtaaataacatggggattaaagcgcgggttacattcgcggcggcgatggcgatcgctgtcgccttcctcccaaaagtggaggacacgaaatacaaagtttataccgatatcgctggcgtttcgacggtatgcgaaggcatcacggggccggacgtaatcaaggggaaaacctatacccggtcagaatgcgatgctcttttggcgaagcacatccaggtcgcaaagcgtgtagttgacagcaaaatcaaagtggccgtgccggacaccttcagggcgtcgatgtacagcttcactttcaacgctggcggcggcgcatactccggcagcactatgctgaagttgacgaaccatggtcggctatatgaggcgtgcgaacagctttaccgctggacgtactatcgcaacccgaaaacgggcaagatggaaaaatcgcgcggcctgcataatcgccgggatcaggaattcaatctgtgcattaaggatctaaaatgagtagcttaaattttcagcgagcattggcaatcggcttcatcgtgtgggcggttgcactggtttccggttgcgcttccagcgtcccgatcctttccgatctggtgggcagcaagccggatatgacggcgcaagtcggtgcggagaacgtgaaacaggcggttggcgtgacgaacaaaacagacacatccagcaagcaggaaacgaccttcaaagaatcggcagttggcaaggttgacacttccaacaaaaaggcggtgacgacctccagcattcacgcgaaccagattacggcggataagatcgagatccgaaacgacgatggcggaagcatgattccgtggctgattggtgccgttggggttatcatgttcgcggtcggtgttttcggtatgtggcgagagcgaaaaaataaaggggcgtaagccccttttttcatatgtaccgtttgacgtgcagcagtgccacgccatcttcatcattcaacccatgttcaaccgtgtttgtcgcggccatgccttgatatagcaaggtgagcgcggcacgcaagtaattttctggtgtgatctgattcacgcaaacaagcctgtgaacctccgttatcagatcttccacctgctttcccgaatagggcttcatcgtcgagttgctcaatgtgcatcatctcccacatgtatttgttgtccatcccttcaaacgaccggaagttaaacccaatctccctgttatccgggccagtgcaccacaccacgccgttttttccgtcaaggtatccattcgtatagcttcgcgctaaaaactccttagaaaccattgaggcgaacatacggtgtgacacgttggcggcttttgccatgcgtggcgattcgcggtgcatgtaaacgaacttcgcaaaatcttgccgggtgaattcccggcgagactcgcagaatcggtaaatgtcaaggataaacattcattacctcatgaacgaagggttaataaagacctctgaatcaatcacgcagatgaaccccaattcctccattttcggcagcagtttctccttaatccttttgctcaccccggactgacctttgaagatcttcagattgcggcacgcgttatagatgctctgaaccgtcatcacgcctttcgcctgcttgccacggctggcgataacatcgtacaccgccttaatctccgcgccctcaccagcgaagccggacgaatcagccgacgacaaatacgttttgctcaactcatgaaacatgatgatggcctcgtcgatcgtttcggttccgatcttcttcgagcgtttgccgccaggttgccagttgcggatcgtgtggattaccgaagccaggcgcatcacctgcttatcgaatttacccatcgcaccgcgcagcatcgtatgcgaatacttcccgccgtcgcctaattccggctctaactcctgtcgggccttgttcagccgacgcatgcctgcttcggtcacttccagcttgatatacgattccgtcataatgtcatgaatgaggcggaagtaatcagcgcgtaaagacttgtcgatcggctcataggtcgaattcccgttttcgtcaatgaacacacgctcacctaaccgcgtttgctcgcgaaccaaaaggaaacgctctgatacaccgataccgcgagaaccagcttgcatgatggcgtcgatggtttcatcctgggcgattacgcaaatacagcccagcgctacgaatgacatattgttactgacgtcggaacgtgcgatcgatacgtggcccttatcccacgctttcaacaccagttcgctgttcgtcttcttgccgccgtcgttgccatacgttatccctaacaggctgttaaccgctgtcgcttcgtccgagataaccgcaaagtttccttgccgattgttgattttcgccaggccttccggcgtggtatcggaaacggggaacgtcagatcgcacatgctttctaacttctcctcaagttcgtctttgtcttcgaacagtttcgccatatcggactgcgataactcgcctttcatggcctgcttgttggcggacaacttcgccatgatttttttgcgctctttcttgcgcgcctcgttgattcgctcaacctctgcgacgatcggatcgatagccagcgagttaatcgcagacttaccagcggaaggcggctgcgacgtaatgacgtaaagcgtcgttggttgctcgctgccgtggtactccacccaaaagcgacccatcatcgcggcggacactgttccgaggaaatgcatataagccgatgattccgggaattgaacggagcgagcggcgttgagcgccagcttgccgacgatatcgtaatcattcgcgatcgagatcgtggggtacttgtccgcgtttacgtcgatatctttcggcttgggccagaaagaaacggagtcgcgatacccgttcgcacggatggcgacgcgcaaggggctgatgccttccttctctgcgatggcaataatatcttgtggggacacgcggtcatttaaaaacatgccttgctcctgattggttaatcgtgcggctaatgataagccgtcttaaatccgagatccagtgataatctaaacgcacttgcaaaatgtgcttaggttatcggggcgcatggccccgaatccgttacaggtatttcgcctcaaacgtggtgccgtcagacacgctgaaaccgacttcctcacggtagagcgtccatcggcaaccgtcacggtcgaagatgtacccggcgacaccgcccagcgctcgaccactttccacctggtaacgcttgccgacggtgaaggattttttcaccgggtttttgtggtcgaggccaacgcatttcagggttttctttttcagttcgataaacgtcgccaccaccacgccgccaacgccagcaatgaacaactcaccgctaatgccgaccgacaagtaaacgcgcttcttcttcagttcggcgctgttatataccatcattgacacattgccttcgtcgtcaatgcgagcggaataaaggttgttttcctggatattaacagcacggcttgaggtgcatttaattttgattgactttgccattttatttcctttctcccatttcgatatagaggtttaccagatccagaaagtcggatttgtttctgcaactcaatttaaagccaacgtgcgattcgatcttattttgcattgccgccatcgttgcgccgccgttattcatcttcagaacttcgcgacatacgtcagccagtttcttagatatcatatttcaccaccgtaaatttagtgtttttgcaagcgccttcgatatcgctaattaggcgattcactctgatattaatcatcgttttgtggtgcatgacgtcaacaatcccacaaacccacaaaatcatgattgaaaagataagagcaccaggcccatacatagaaaatagtgcggtcattactgcgatcgtgaatttcattctggttttctccgttgcgtttcgatggaataactatacccgcaattaagcgggtacgtttagcaattcgtgctattcattaaaattcgcctggaacacggcgcgagcgaatccgcgcggagtgatagagcgaagcatctttgttctttcagacttgccgccaaggaatttccacgcccaaaagaaatcgacgccctccacattttccggcggtaataaccgtttcggctccacgaatccgttgccgtgccagatgcacgttttcttcgtgtaattgtcgcagtgcggcatttttgggtgccaaacttcctcatgcggcgcaacatacccgccgaagtcgcgagggtggaaataaaaatccggcttgcgccaaagcgtcgacaatttgccaaccgggttttctaccatccaggggcaattatattggtcgcccaattgctcgatcatcttcgcatcatcggcggctgataaaacatcctgagtctgccgggcgtgcttcaccccgctatgcgctaacagcgtgcaggaagggaaagcgaaaataatgtcaggatccgggatgcccaggatcgtgcgcttcacgtcgaaatctttgtcaatccagatgttgacatactggatttttgcatgctccatgcggattttgtactcgccgtggtcgccggaatcggcgttaaagcaatatacatcgcaaccgcgaattgcccacggcagacccataatcccggaaccgtcaaacatgcaccacacaacgcgctttttcatttccacctcaccagaaagggatacattcgcggcaaccttcttcaccagtgcagccgcaactattttcttcttgctctaccagatcgtcacgcatcggcagactttcggcatccatatccatacctcccagggcatccgatagcgtcatttcctgattggctactttgatgcaatattcgcggttaagccccgcgtcctgggcggttaagaaacggtgccagtaggcatcgtcgtaattatcagccattgcttttcctccggttaaattctcgcaaattggcggcgcatgacttcgaacaggttttaccccagccgcgtttaagatccgccgccttgaccttatagacagccccgcatcctggagcctcgcagcacttcatgctttccttcgccccgatgtgattcggtcgaccagtcagggagctatcgccgggattcttcgtcgaccagaaaagttgcactgtcgcgacctcctcgccgaactcattaacgaacatgtagacgcccttgcttttcagaagcacggtgcaatgatgcatttcgccgttgacttccaggtatgcgcgatcgccttctttcattagcttctccaagattcaatgaacatgctgttcgattccagcgtcagcgtgacgccagccagggatgacggaatcaggcgagcgccaggaaccgtgccgacaacatagcgaccattcgatttggtgatcgtgatctgagtaaagccggattcgcggttcatgcggagaacaacgcggccatgtgcatgcaggacggccaggatcgaatcagtctttggatggttcattgtgtaactccttcgtttgttggtgtggggacagtatgccaccatccccaaattctgttttagcaatttgtgctattctggaacgcaggtagtgtaatcctggcagatgtagattgtgcgctgaacacgcggcgcggcatcctccaggctctgaatctcgatatcgttgctgtcgaccaggcagggtgttgcaccgaagatgaaataccccgtctgcttgtcgttgatttgccacgccttgctttcgggaaccgtattgacgacaaacggcgtgtcgtcggctttgaagtcttcagggtgacgcccgtaatagtggatgattgcagcagttgccgccgccttaaacttttccgtcacgtcacgggcggcgatctcacgcgagatctggatatcaacatccggcgcgccgaccatgtaggaaaagctggttgaaatggtaactgttctcatttagattttaacctcgtttcggtggatgaagtcggcgacatagtggcactcgatcgggttttcgatccctgcgagaacctcacagcgcccgttgttcagtaactggcaatgttggcaatccacaccgccaacattggctatcacgatggcgatcccgttgcatgaaccgccgaacatccgatgagggaaggggtaagcctcgcaggtgcaaaccacctccccggccctccgctttctcatgcgctccccttctcgatgcagaagacccaatcgcgagcatcaaccgcgaagcgcgccacgccgtcgagcacgatgaaaacggtctgcccgttaacgcctcgccctttctcgatatcggtgacggtgcggaacaggtcgcttgcgccatattgaattttgtcaccgattacgacgtcgccaaatgctttcatggttgctctcctgattggtttcgatgtggtaatgataccaggcctcgcggcccggcgtttagcaatttgtgcttatttgatggattttttcgcggccttgtatgcttctttgaacgccggaacatcttcgatctcaatccagaagccggagccatagccatcgtcatagcatgggcattggtcgcagtagtcgccccaggttttctcttcgccgccgacagagaagccagttttcatttcgcagagcgcttcttcaacggcttcgattttttcagcatcggtatccatgattacgaaattccatttgccgttatattcgttgccaagtttgattgattcgcgcttcagtttcatgatgtttgcctctttgtctgcttcgtttcgatgaatagataatagcaaaagcccacgcggggcttttaacaaaaagtgctatttacaccaggcggaaccgaacttcatcaccgtaaatcacggcctgaatgtgatcgccaaacgtgacggttgcgcgggtggtttcgtactccgtgtggccgtatcgccatatcccgcgctggggataatgcgccgcgctttcgtgccaaatgttcatagtgaactcgccagactccccgaactccaggcactggccgaccatcgctttgatggcctggtagtcatgccaacgttgagtagcacgatcggtaacgcgctccacatgcttgcgctctttgtgctccgccgccgcctcaaccacggcccacttactacgggtaaagattctcatttctggtactcctttttgatttgggcgcggaaccgcgaagcatctttttctgcccgttcagcgctgtgatatcgtttcagaaacagggtatcaatccccatgcaaagcgtttcgtcggcgctgtatttccccacaagccaaagactgaccgtctgcctgtccaggccgtagttcttatcgaagtgaacgcgcacattcacagggacgtagccatgcgtcgaaatgaatgcgtcaacgcgatcgaatagctcttgcttgttcatgattattcctcaacggtgaatttaatcggctctttcccggtcgccttgcgatgggagttgaccagcgtttcgaacttgccgatgcactcgcgcaaatcagtgaacgtgctggcgctccccatgacacgccatgattcgacattctgcccgcgaacatagttgatgacgtgcttcatgattttgtactggtcgccatcctttttggtgtacacgtgcagcactgcgatcctggttgatttgtaggcgaatgctttggtgatgtatttgcaagtttgcatcgtgttcgctcctgactggttgatgtgatgactatacccgatccctccagcagggttttgattatttgtgctattcctctgattgtctattattccatctattcggaatagtggaataggctgtgattgcatctgattccctggtgattacttttgacgattcatgattgattgtgattgtttcattctgtgcaatgtgatgatggagtgtttcatgatgtgcaacgaattgcatagatgcatgcactatgcacataatttgccgttcgaatcctgcaaaaacggttgccagttcacagtaaccgaatccagttcacgcacagttcagtaagataatcttacgtaaaagttgatcaaaaagtgcgcagcataagcacataaacatacatataagtatatgataaacttaacattattattattattctattattctctctatctgaatattccagttcacgtaagatagtaatgggatgcgctaccatttttgcttgcgacagcccccaaaaaattcagtgttccgcgccgccagggtatataggagggtgtgggtgtatcttactttcttacgcaaactgacttgacgccttgccacgcctggcttagcatgcttactgaattggaacggaagtggagagaattacagtgaacaagagcgaaattgaacaaaagtgggagtttgagcaggtcgatcccgaagtgtggatggcctatccgccagataaacaggccgcttatcatgcctggctcgctggcgatatcttcggcgatgatgacgaaccggagccggagcgcgagcgtaagcaggtcggcggtaagcgcgaggggccaaccatccaaagcctgattgaacaggattttattgatggcggtctgtccggcaaggtcgacgtcgaggagttcagcgccacgcacggcaagcagatcacatcgcacgccatcaggtcggcactgaagcatcacatcggcaaacatggcaagttcagaaccaggacgcgcgacggcgtgatcgaatactggattgaacgcgatgaatcggcggttagcagcgatgagcaaatccaggccgaccgggaaagggttatcggaatcattcacgcgctgaccggaaatgatcttgatgtgcgtatcgagccaatcacggcacgcgtgcttatccaggctatcaaactgaacgtcaaagcaggagatatcaagtgaaactatatcaagaccagtccgaccaggcggcaccaatgcgcctgggaagcgagccagtaagcgagcagggcgttatcgacgcagtaatcaatgcatcacaggcagaaaatccaagcgccttagaatgcgttacaggtgacttgcttttggtgtcatttcttccagattctgagtcatacatccagcacattaccgaaacgggccaggcagtaacgcgaccggagttcgtcggagcgcctagcgtgcttcagatgatgcttgacagcgccgacaatatcgttagcctggactatccgcaatagcactttttggtaaaacccggtcagagggatcgggtattatcaccacatcaccaacgagaggagcatcaaccatgccacgctttaacagaacgcttcaactccgcacctttgccgggcttcagatcccgaaggagtcaacgaaggcagtaccaggccgtgaattcggcgtgtacttccactggcggggccactggcgctttaccgtcattcgcggcttttacgtcacctgcgacggcgttgacattgacgaccacagcggcgggaaccaggttcacaacttcaaatagcactttttgttaaacctgccgtaacgtcatttggtaaagtggcgttactgaagcgaaacaaaccaatcaggagcaacgcaatgaacgataatttaatcgcactgctggaagaactgaattcctacggctgcgcatacatcgagctttcgagcgagcaggttattgaagtcgcaatcgacgatgacgccgggttcaccagattaagggtggcggcaggggccgaagaggaattcgaagactgcggcatccgtgaagtaaccaaccttctcgaatcccaccaggtgaaggagatccgctaatgaacacaatcaaactgaaatgcgtgtcagtcgagtcgctcgttagcatctcctgtaagcctggcgatatcatcaccgccagccgggataacgagttctcatgctggcacttcgacggatactacctggatgatgatctggtggttcgcggcatcttcggtgagttcgcgcggttcgaagaggtgaagcgcaagaccgatcgcaaactggtggttcgcgcaatgtgcatcatcgcccgccagtatgggtggactgacgcaggcgttaagcgcgtcggcaactacaaaaccgtcaaggagtgggcgcgggattgggccgcattctacaccgacgaaaaaggcgagcttcagcacgatatcagcgagtacctggaagattgcagccgtggcgatgccgtccgcgagttcatgcaggcagaaatcgacgccctatagcacgaattgctaaaaccgccgtccggggatggtgcatactatccccacaccaaccaaagaggaaaaatcatgagcacctacaaattcatcctgaccccgaacgctgattctcccgctggcgtgggcgcgaaattcaccaaaggcaagcgctatgatgccgagcatttcaccaactataacgggtcgccgctgtacaagatcaccgacgacgaaggcaacatgtacgcggtcgacccgcgcaactcgcactacatcggcggcggtcagttcaacattgagttgcaaatcaacaactgtttcgctggcggcgaactctcattcggcgggttagttagcgatgcgctgaaataccccctccacacttcggcgtcaatgttcgtcggcgttacctccactgagtcgccattgttctttgccgacctgaaggcccacgaacgcgataaagatcgcgatctcgaatcaatggtcgaccgcatgctgaacatgttcggtcgggatgagtcgcggggcgttgtacgtggatttaagatcggcgctgaaaaatccgcgcacttcaaagagggcgtgaagtcggcaagcgatgcagttgcagccctgggcatgctgtcacggtcgatgatcgtgaaaccggaaggcgcgaaagaaacctcgctagctgaccgggttaaagagcttgagtcagagcttaacgccgcccacaacacgatcgagaaaatccgcgaagccatgcgcacgccggaaggtgatgacgcgcagacccatgcgaaagttctccgccagatggctgacgccctggttagtttgtggcgcgacggcaaatagcactttttgctaaaacttccgcaaggccatttgatatagtggccttattgaagcgaaccaatcaggagctaaacaaatgagcattccgtatccgaccaaagacaaatcattcctgggcctggccgttgttgagattgtcaacccggatgtgaccaactccccggatgagcctacccttgcacagtgggccggattcaaagcaggcgatcgactgaccgtcgaatgctatagcgacggcgagaagtgggcgcaggtggggcgctattaccacaccgaagaatttggccaggtgctccctaccgactggttcgaacttaacgaaggcgaatataaggtgatcgaagaatgaacaacaaaatttgggtgctgacctacactatcgggactaacgaggggcgcaaatcgcgccgcctcacctgcgacacgaaagcgcaggcggaaatgcagcagcgcgtgctgggcggcgaagttgccgaatacatccgccagccggaatccttccaggtcaattggcctgagaagatggatgttgacgccgtactgcatgaaatgcgccaggtgcaaaacgacccggcggcgtggaaagatctgtacctttgcggcggtgacgctgagtcagtccgggatcccttccgccttgtccggcaggcgcacgcggaatggtcggatcgccagttcggcaacgttggcccggtcggcccgctgaaacacctggctaaagaggccaatgaagcagccgaagcgccggatgacattagcgagttcgccgatatcataatgctggtgtgggacgcaacccgccgcgccggaatcaccgatgagcagttggcagtggcggtggcggaaaagctggagcggaacaaacgccgccagtggggagcagttaaagatggcgagccgtgccaccacttgaaaaattaacgaattcgtataccatttaaagcgcctgtaagcgattctggcgggcgcaaatttcattaaggtgattctatgtctgagttctcaaaagtcgaagatatgccgattggcgcaacggtaacgggtatccagatgagtgagtcggtcgatacgattactccgctggcctttccggttacacaggtcgaaaccgacagcaagaaaggtttcatcttcatctacaaaaatttcaacgcccctctgcgtgtcgagatcttcattgctcgcggaacctgggtcgaatgggagaaggcttaaatgttcggactgaatgaggcgcagtacaacgctgtgaagcgcgtggcgaaacgaatgacggcggaaaccaaagacgccatacggaaagacaaaaagacttacgatcaggttgccgcccggatgatcgataagcattgggccgaagtcaacacgctgttaactcgcggtcagtttatctggctggctggctatctcgaaggccgtttcggtcgccgcgatggcgagcatgagtaaaaaataagcgaacgaatcaaccgcctattgacgcattcgcgctgaccgggtatcgttaaaagcgtagacacaagaggcggtaaacatccgcaagtctcgccccacttcggggcatttattggggggtgatgatgcagtacaaggtcatactcacagcaaggaaaatgggcggcttttgcaagtcctgcattcaagagttcagcatgacgattgaagcgaacgataccgccgacgcggtggagaaagcaaagcatcgttcaggcgtcaacctggacactcacaaaataagtatcaactacgtaagggaagcaacacaatgataactctgattgtcgcgttaattatgctggtcataggcttctatgcaggcaccttccaccttgtcgaacggctgtcaaagcgcgtgcatgaaggcactttcgccgcgatgctgtacaacaagaaaacgaaacgctgggagaaaattggcgatccgggcggtatcgcgaaacgaatagagttttcgccgctcccgtatgctgactgtgagccttttgcatcacttcagaaaacactgaagcggcgtaacaaactgatatgaacataacccgcttcggcgggtttttttgtgcctgcaatctggtatactcgcaactcaacacagaaggaggattaacaatgtctgaagaacgcaaaaaacgcgtaacgaaatcgcacttcgaaggcaatttcaaggcgctgtacgaaaaagattttggcgtagtgctggggcgaaccgccgaaatgacgccacaacaattcttcgagatcgcgaagggttatttccagtgggccgaagaaaacgccatcaaggctgcggaaaccgccactttccagggcgacgttaacgagtggggcgtgaacaagccgcgcattttcacgatcacagggttaagcctgttttgcggcgtgaaccagtcaacgcttgcacgctatcgccacgacccgaactatgccccggtcatggagtttatcgactctgtaatctatgagcagaaattccagcttgctgccgtaggcatgattaacgcttcgttcgtcggtaaggaaatggggatcgacaagcccgccgttctcaacattgacgccgtagctggcaacaagaacgagatcaccgatgaagtattggagaaggctgttagtaacattctggacaagatttaagggccgatcatgaatgatgaaatgattatttgggaagacctgaagccagccgataagctggcaatcaaggcattgagcacgcgcaacttttcgctattcctgaagatctggtttcagattatccagggcgaaaagctgatgtggaactggcatcactcctacttttgccacacggtagatgaaatcatcgccgggaagcgcaaaagcacgatcgtaaacgttgcgcctggttcgacgaaaaccgaagcgttttctatccacctcgcgccgtatgcgtatctcaagtgccggaaggttcgcaaccttcagatctcgcagggtgatgcgctttcaaaaggcaactccgaccgcgtaatcaagatcttttcatcgggcgaatggcaggagttatggccctcgaaattcggacggaagcagatcgacgaattccaggttttggatgacaacgatcgcgtaaggctggaaatggtgtcccgttcgtctggtggtcagatcgtcggtaagcgtggcgggtacatgacgcctggtttcagcggcctaatcgcgctggatgatatcgacaagcctgatgatatgttctcaaaggtgaagcgcgaaaagagccacatcttgctgaagaacaccattcgctcccgtcgtgcgaagaagaaacaaggcgacgaaacgccgatcctgtccgtacagcagcggctgcatgcacaggattccacctggttcatgatgagcggcgggatggctatcgaattcgatcgcattgttattccggcgatggtaacgagggaatacggcgaatcgcttcctgactggttgcgtcctgagttcgaacgcgacgtgttatccgggccgtcggtggtcattgatggtgtcgaatactggtcattttgggaggacaacgaatcgatcgagaacctggttgccttgcgcgatgccgatctttatacattcctttcgcagtatcagcaggagccgatcgcattgggcggcaacgtgtttaagtcggaatggtggcgctattacggcgacagcgaaaaggcgcatgaaccgcgcccggacaagttcgaatacaccttcattactgcggatactgcgcagaagacgaacgaactaaacgactattccgtgctttgctattggggcaagtaccgcgatcgcgtctacttcattgatggaatccgtggcaagtgggaagcgccggatttgcgcgtgcaggctgaggcattcattaagcagtgctggcgcagaaacaaggaatgcgggaatctgcgaaagatttacatcgaagacaaggcgagcggtacgggtctaatccaggatctgaccaaagcagttaatggcatgggtgagatcgtcccggttcagcgcgacaaagataaggttactcgcgcgatggatgcgcagccaattatcaagggtggccgcgtcgtactgccggacagccatccgttcattgcggagcttgtggcggaaatgagcgcatttacctatgacgattcacatccccacgatgacatttgcgacaacgtatttgacgccgcgaacctggaaatgaacctgagcgatgacccggtagaacgaatgaaacgccttgcaggattgaaaaagctgggccgctaatacataatgtgggcttaacggcccacaaatcacacaaggttaaaatatgaaagctatcaagatggatgactacaatcagatcttcaatggtggcgcgggttacgcgtcaaccacggctatgattgcaagcacgttcggggatatgtcgcaagtcgaggagttctatcacaataacggactggcgaaaaatattgttgacgtgatcccggaagaaatggtgtcgccaggcttccagcttaacggcgtctccgataacacgaaattccagtcagagtgggacggccttaaacttgagccgcaaatcaccgatgccctctgctgggcgcgcctgtatggtggctcttacgtcctggcgatggttaacgatggccgcatgctgacttcagccgcgaagcgcggtaagccgctggaatcaattgtcgtttacgactacgattcggtgtccgtagcggaggaggagaagaacccgcgaagcccacgattcggcaagcctaaaatgtacaccgtcaagccgctaaacggcggaagcgactttaacgtgcattatacccgcatgcactacatcgacggcgagcgtgtaaccaacaaggttcgaaaactcaacaagggcgctggcggtacggtgctgaacaagtcgatgattgaagcgattcttgattacgattattcggagtacctcgcaacgcagttgctgaagcgtaagcagcagggcgtatggaaggccaaaggtcttgctctaatctgcgacgacagggagggcgaatacgcggcccgattgcgcatggcccaggttgacgcgaattccggcgttggcaacacgatcggcattgatgctgacgacgaagaatacaccgtaatcaactctgacatttcaggcatcccggaattcttgtccgccaaaatggatcggattgtcgcgctgtcaggcattcatgagatcgtactgaagaacaaaaacacaggcggcgttagtgccagtcaaaacactgcgttgcagacgttttataagctggtggagcggaagcgcaacgacgactacaaaccactgttagaatttctgctacaattcattgtcactgaggaagacttcagcgtagagttcgaaccgctgtcactgccgaccgattcagagaaggccgatatctttaagaagaacgcagacgcagtacacggactggtaacggatcaggtcattgatgctaacgaagcacgtgataccctgtccgcgatggttcccgaactgaagttgaaaggcaatgcgccggaacagaaaaagttaccggatcgcactccgggtgctggtaagaccaaaacgcaaaaatcgcagatcctgaacaacaccgaggagggcggcgatgaaagttaacggcagaattccaaactggcgttatcctgaagcaagcgagcgggatttatcccgcttgatgcaggacgcgacaaccgatctggtggtagaaatgcgggatcggttagaccgcctgaagttcgacgccacggcggaggaaatcaacgaggcggaagacgatatcaacgaggcggcgatcgcgttctttgctgccgtcattgcggcgctggcctccattggcctgactatctaccgcttcaactctaatcagtggctggttattgcactggcggctggcgggcgcgataatgaagcggtcatgatgctgaaggagttcggcgctggtggttatgagcagtggtatcagcaggcgctgaagaaatggcaggataccgcaaaggcatcaatccagaagttaacagccgatatcgtcgctgactggacaacgaaagttcgaaccgccaacaacatcggcaagactcgcgaacagatcgatgaaatcatcgagggccgatacgccatttatggcagttggtcgcgcaaccgggcgagcggcattatcggaagttttaacagtatgttgatgatgcagcgactaaaagatgctaaagtatcgcattacttttggttcggcatgatggacgactgcgaacgcgaaagccacatcaaactagaaggtaagcgacgccgcgtaaacggtgacggcatttttcccggcgaggagtacggttgccgttgctgggcggttcccgattttaataacgtagaggaattacaatgaaaagagttcaaagattcgacacggtaaaggtgaaggcccgctttgatgaaaacggctttctggtcgataccccgatcgttgcgcgtatcggcgcacagacctaccagaccccgaacggcccgcgagttgagtttcgcccgcgctccgaggtgttcgacgctgaatcgctggcgtcataccagggcaagccaattactttgggtcacaagatggtcaacgccaaaaacgcgaaagggctggtggtcggatcctgttccggcgctggcaaagaggacgggatcggggttctggttccggtgatgatttacgacggggagtcgatcgagcaggcgaaacagcgcgtagcggctgaattgtccgttgggtacacctcgatcgatatcgacaaaaaaggatggggcaacaacgcgacgggcgaatactacttcgatgaagacctaccggaaaacttcgaagaactgaaaaatgactccgtctctgattgggttcgctttgatgccgtgcaaacgaagattcgcgttaaccatgtggcgcttgtttttcgcgggcgtgcaggaattgcgaaattaaatcttgatagtgagcaagaatttccctatgatgacgactcaaaccacaaaggagctaaaacgatgattatcaaaattgacggcgtagacgtcgaagtagccgataacgtaggcgcacatattgctaaactggacgcacagatcgcaaccgcaaccagtcaggtaacgagcatcaccgcagagcgcgacgcacttcaaaccaaagttgatggcattgaagatgaagtggcggcacgtgttgccaaaatcaaagccgacgaagacgcgaagcagaaagttgtcgcgatcgtatccgccgctggcatcaagtgcgacggcctggacgttaaagcgatgaaagttgcttacatcaaagaagcggatggccgcgacttgtcagataaagaagattcgtatatcgacgcttcttttgactttatctccaattctgataagatggcaagcaatcgctctaaagtcttcgccaaaaaagaagatggtgagcaggaagacaagaaaggcgcgccgaaactcgatggttccaacatcatcgacccgcaagccaaattccgtaactaataccgtgcggccttcgggccgctacaaaatccaaatcaaggagatttaatcatggcaattcctgcaacctatacccgcaagcgcgatatttgcattccgggccagatcgcggatacttcgctatacaacatcgacggcacctgtgccgctgcaaatgacattttaactggcgttctggtcgcgttgtccggtggcgttgttgatggtcataaagtggtcgataccgctaaaactgctgatgctgttctggtgggcgtaaccactcattcccattaccaatcgccggaattcaaatacgacaaattttccgccgtaaacgttatgacgcatggccgcgtgtggtgtcgcgctgcatctaccgtaaccgcagcagattgcgcgtttaagtcgctggtaactttcggcgctgatggcaccgtggcaaaaggcgatgctggcctaatcaaaaccgggtacactcacactggcgagtggttcaaaaacaaagatggcgtagtcctggtgaaaatccagttaacgcaggacgcaaccgcgccagccgcccccgctactggtggggcgtaaaaataggggcttcggcccctttttcatacgttaaaaaacctttgaccgtttagcaattcgtgctattcttcatctcgttaagtcaaaacacacaaacaggagtttcaaatgactatgaaattagatgcattcgagcagaatgcaatcaaggttgcaatgcagggtatgggcatcgacgctaacaaactcgatgcgcacggtatctggactgtcaatcagcttacccaactcttaaatcgccagtacgaacaggcttacccgcaaactggtgtgctggagcttttcccggttactaccgaactgagtccggtaacgaaaaactttgaatggctggagtttgacggcgtgacctctgcgaaaatcatcgcggattataccgacgacctgccgaccgttgaagcgatggcgtccgagaaaactggtaaagtgttccgcctgggtaacgcgtggtttatctccatcgacgaaatcaaagcaggtcaggcgctgggttccagcctgagcgaccgcaaagcgtctcttgcacgcgaaggccatgaaaccctggttaacgatctggtgttcaaaggttccgcgccgcataacatcgttagcgtgttcgaccagccgaacattaaccgtctgacctccgcaggctggactacgccggaaatcgcattcagcgagttgcaggatctgatcgagacgatcgaagatgtaacgctgggccgtcaccatgttaccaacatcgtgatcccaccgtccaagcgccgcctgctgacgcagaaaatgccggacgttacggaaagttacctcgcgtggttcaaagagaactacccgaatgtaaccatcaccgccattgcggaactggaagatatcgacggcgcaggcactaaaggcgtgctggcatacgaaaaagatccgatgaatatgtcgatcgagatcccggaacgcttcaacatgctgccgatgcagccgaaagacctgcatttcaaagtgccttgcacctccaaatgcactggcctcatcgtgtatcgtccgctgaccatcgccattctttctggcgtgtaattagaatggcccttcggggccattttttattgttgcgaaaaacctttcattgtgtttaaatcaaacctcaccaaaacaggagagatacaaaatggctaaaaaagatactgctaccatcgaaccggaaatcaacgaaaagccggaaacctcacagccggaaaccgcgaagccggatatggtaacaatggaaaacgtgggcgcttgcctgattaagttcgacggcaaaaaagtgctaccgggcgaaaccttcgagatcgaagagtctcaagttaaccgcttccgccacgatatcttcaaaggccgcgtagaattccacgatgatattcgccgcactcgcgactacatcgcagcagtgaaagcgaaagcaaaaaccatcgtgcagcctacgagcgccgaataaaaaaaccaacaagggcgctacggcgtcctttttcatatctggagaaagaccatgaattacacgattcaagatgtgatcgacaaaatgcgcagcctagcgccgccgcttaaagaagtaccggaagaactgttaaccgcgtgggtggtgctggctgaggaattcgtatgcgcgtctaagttcggcgattcgatcattacagcgttggcgctgatgaccatgcacctgatgtttctggacggcgcaatgaagcaggaaggcgaaagcgtggaatcatactcgcagcgtgtagcgtcattcaccctgaccggggagttttcccaaacattcgatcgcgtgtcttcggctagtgataacgaaatgctatcaactccgtggggtaaaatgtactggcgcatgctgaaaatgcgcggcggaggcttcggccttatgaccgctggcggtcttcatcgttgcggcatgggaggttaaacgccatgaactacaaagcaattcaggcccgcgctagtgcgggcattaagtttttcagcgatgccgatggcgtattcaacaagtacaccaaaggcgctggcggcggcatcgaccccgaaaccggggaggatatcatccccggcgaggttgtgaccacaatcaaaggtgcggtgcgggatatcaaagatcgcgatatcaacggagaaactatcctcgctggcgacaagcgcggcttcttcactcacgacgtaccaatcatggaaggtgacgaaatcgacgtcgacggggagcgctatcgcgtggttaatgcccgcccggtgaaaccaacgggaaccgtcgttgcttaccgtccagttttgcgaagggtggcgacttatggctaattacaccatccgtgaattcactggtgcgattgatgcatggtgcaaggcggctggtgatgcgctggaggacgttgtacgcatgacgtgcgaggatatcctaaaggatcttgtgatgcgctctcctgtcgatacaggccgcttccgtggcaactggcaaatcacttttaaccgtgcgccactttacgccatcaacgcatacgaccagaccgggacgaagactatccagaacggcaacgcgaacattgcgctgttcacaaagggagccgggattacttcgatctggttcagtaacatgctaatctatgctaacgcgctcgaatacggacactcaaaacaagcgccgaatggcgttatgggagtcgtcgcgatccgattaggcgtatatgtgactgaagcaatcaaacgagcgagggcgaaaaatgcactatgatattgcgttaaaatgcaaggcagcggcggctaaatttgccgccgataacgggattattatcgcgagcgataacgttgactttaagccgccagccaacggcggtacgcaccttaaattttcatacatcgaagcggattcccgatctgttagcctctccagggagtgtcgcgtttacttggggctggttcaggttgatgtgatctttaaacccggaactggcaccgacgccgcaaggttaatcgcgcaaaacgttgcaaaatatttccctgaaggtaaaatcttgggcgatgacaaaattaatctttacgtaagcgagtgggctgaggttcacggagtgcagaaggcgcaaaccgggtggttcttccccgttcgctttacggtaagatgtgaacaaatggaggcgagcgggtatgcacttacctaacgggagcaagatttttattgaggccagcaacgagagggagtacgattttaagtggcttgacacaactgatgttggcatcccaaacacttatgttctcgtattaaatcaggcggctggtgtcagcgcttttggtgttggcgatatcgtagtaatcaccgagtgcgacaacaagctgatcgagggtaatgtatactcgatccgctctgttaatggggacgtttcgagggttagggtatggccggagtaccgggctaatgatttgccagttggtaattacatttcatcgcccggaaaggttcgtcgtatttcatcctgggcggaactgccttgcgtgcagtcaatcgataaggaaggcaacgaacaaaactggtatacttaccagtgcctgagtagcggaagggaggaaagacagaagacgacgaaatcagcgttgtttatgtcctacgtcatggcgcacgatccagacaaccccgcctatgcggtgatgagggagaaggaggccagcaagcggctgatggcgatgcgcatgcacattcctcgcgcaaaggaaaaccgctattggtctggtaacgtctcattcgatgacattccgtcaacgacggtaaacgaaatggagacggtgacgctacgcatggcgattcgaggcgcttataatttcttgccatccagctaactagcgggcataatggcgaggttaatcaaacatcaaacaggagtattgaacatgcatttaccaaacggcgctaaagtcttctttgagaaggcacgcggagcggagatcccgtttaccgcaatgtcaaacgacgcgttaaacccgaaaatcacggttgctgaaaatgcactgaagccgaaagatatcgtaatcttcacggattgcacctggggcgactttgtgaacaaggtggcgcgagttaaatcggtggcggcaggtgttgcgacgctggaagaattcgacacttctgacgttaacaaatatccgacggcggcaactggcaaagttagcgttatctctgactggatcgaaatgccatgcattcaggatttaggcaaagacggcaacgagcagcagtattataactaccagtgcctgagcgacgaacgcgagcagtcagaaccgacctacaaatcggcggtaacgctcaactaccaatttgcgcatgagtacgacaatgcgatctacccgatcctgcgtgctgccgatgccagcaaagaggcaaaagcgatgtacatgtacgtaccgcgagcaagcgaagttcgttattggtctggcgtcgcctcctttgacgatatcccgtctacggctgtgaacgaaatggaaaccgtcacccttgacattgcgctgaagggttcgcacgtcttcctgcctgtgtaactggcaaataataactggcggggcttgtgcctcgcctttttttatgcataatagcattcaacacataccaatcaggagattacaaaatggctaagtttaaaattcgtattggcggcgaactcccatccttcaaacttccggtaactttcacttgccccgatggcaaagatgcaaccatcaacatgacggtaaaacatcactccaccgatgaaatgaaggagttttatgaaagcgaagaaaaagcgccgaaaggtaacgtggattttatccgcttcatggccgaaggctgggatctggacgaagaatttacggatgaaaacatttcctggctgtgctcgcattacccttcctttgtcatggcattgcctcaaacgtacatggccgcgcttgccgggcatcgtgcaaaagtctaaggcgggctgtttatctaacgcttcagcctgagttaaccgatcgccagcttgctgagtatggtttacggcgatcggattacgaggctgatttagaggaaattttcttcgatgagcagaccgcccaaagttggcaactattccaggccatgcaaacgcaatggcgcattgggatgaatggcccaacggggctggactataatacattgcctatgttctttgaattgtataaaatcgacaatcgagaagcggcattgcttgacttgcagatcctggagggtgaatacctcaaacagatctacaaaaaatcacaataagcgcctacgggcgcttttttcatatgggggctaacatggctgataaagtagctggcttgacgttcggcgttgacgtgtcgcaggttgacagagcggtgcgatcacttgccgaactgaagaaccaaagccaacaaaccggggcgggtcttcagtcgctggcggacgctgagaagcgcgcgacggcgcagactgaggaaatgaaccgcgcgttgcagaaccaaaagaaaaccacggaaaaggccaagaccaatttcaacaacatcgcgggcgctatcgatcccacgatcgcgaaaatggctaacttgcgcaaggcttcggaagaactggataaggcctggcaattgggccttgtgccggacaaggaattcttccgcctgggagctgtcattgagtcgaccaccaacaagctgagacagcagcagttggcgctaaccgaagaaggccgcgcggcaatcgctgaggctgaggcgaagcagaaggcgaacaacgccgggcgtgattttgtagccagcctgaaacagcaagcagactcgatcggaaagactcgcgctgaactgctggaaatgaaggcggcacaattaggagtatcagcagaagcggcaccgttcattaatgccctgaagcagcaggagcaggagttaaagaaacagcatagcgctatgggcctcgctggcatttctgccgggcaatatcaagcagcaatgcgccagcttccagggcagatcacggatgttgtaacgtcccttgcgtcaggaatgccaatttggatggtggcaattcagcagggcgggcaaatcaaggatagctttggcggcgtagggaatgcatttcaggcgctgaaaaatttaatctttggcacgagcgctgatattaatgaatctctggatgaaaccagcgaaagtgcaagcgatatggctgagagcttcaataataccaccgaggctggcgagaagatgggcggccttgttaggtttatcaaccctgtaacaatcggtgctgttgcccttggtattgctattgcagcaattgcgaaggcaggcttcgacgcgtggaagtcgcaaagggatttggctaatgcactggtgctgactggtggttatgctgccaccacgacagggcagattaacgatcttgcgaatgagttaagcgagacgtctagcgcaacttccgggagaatccaggatatcgcgtcaaccttggcctcttccggaaaatacaccattggccagattaagaccatcacgaagactacggcggaatgggaagcgcagacgggagagagcagcgataagatcaagggctactttgaccagatcttaaaagatccggttaaggggcttgcagatcttaacgataagtttaacttcctgaatgaagggcagttaacctacatcgaatctttgcgaaaaaccaaaggtgagacggcagcggcagatgcggcgacaaaactgtttgctgaaacgatggataagcgactgaaagatgtggctgatagcgcaacacctcttgaaaaaatgtggatggatatcaagaagtgggcgtctgactcatgggattgggttggaaatcacacggttggggcgcttaaccttatcgttgatactgtatcggcaatcatcaacacgatcagaaagttgattaccgacggcgacgctatgatcgcgcagtttgtcgttgacgctggccgaaaactgcaaaaaattcccggaatgggcgactttggcaatgactttctggcgcagcaggagcagttaatcaaggactcgaaagctaaatccgccgagcttgcgaagaccatcgcggagcagcaggcaaggatcgctaaaggagagatgggttacattgacgccgccaataacaaagatgtttccagcggctacagcagtggaacgaaggatcgcgtaaatcaggaagaaaaggatatcatgaaaaaccgcaacgccaggaagcagcaggcagacgcgggagttaaaattgatgagcagtatcaggctgaactgctatcgctacaggcgcagttgaaggttttgcagcagcacaaagggcttgacgacaaaatcagccagcagcgcaaagactactttaccaccgtcgcaaaattccaggtgctggaagaagcgagcagcaagcgtaagctgacgcagagcgaaaagcagatgttagccaataagcaaagtatcatcgctatggctgaacagaaagcgatcgtaggcgatcagattgtccggcagcagcgcctgaacgccttgcttgacaagtcggtgaagtatcaaaaccagatggctgagaagacaaaagcgcttcaggataccgccgggatggggagcaagcagcaggagcgctacagggcaaacgcgcagatgtcggcggactggaaaaataacggaggctcgcttgacgatccccaatttaagcagatgcaggcagcaagcgagcagttttacgcacagcaggatgcgcagatgcttgactggaaagcgggatttacgcatgcctgggctgacattggaaacgaagttaatgacgtgtactccaatatcgggagcatcacccaaaacgcatttaacggaatggctactgtgctaactgattttgtcatgacgggtaaggccagcttcagcgacttcgcaaaaagcgtgattaatgacattaccagcatgctaatcaaaatggcgctgttcaatgcaatgtctgctgcgttcggcggtggcggtacgttcagcttcgccagcatgttcagcaaagggttcgccaacggtggctatactggcaacggtggcaagtacgaacctaaaggcgttgtgcatggcggcgaattcgtctttaccaaagaggcgaccagccgattagggccggaaaatttatacaggctgatgcgtggctatgcttccggcggtctggtaggctctaacggttcgtcaggatctggtgtgacgaatggcgggaatgttgcggcatcggcagcaatggtgtttagcatgggtgacgtgaacatcacgatgggttccggtcaggatagcaagggcttagagcagggagtaaggcagatcgtgaatgatatgttcacggaggcattgagccaaaacggacgcattgcgaaatacgtaaacgagaaaacgaggggttaacagtggattctttttcctggtgtactcaaattcaaggaggggcggcgaaagtcgccgtttcaaacaacgttcgagcggttagtttcggtaacggatacatccagactgcatcgagtggcatcaacacaaagcgccggacggttccgatcgtttatggcgggagggattgggaggcggtttatgatttttgccagaatcacgtgacgaagccatttatctggaaggcaccagatggaagaatgggtgtattcgtcgtaacggcagactctgtgaccctcgcgccgcagggcggtgggttatgcgaagtaacagcagagtttgcggaacggttctcttcagccggatagcacaaagcgccctttacgggtgcttttttttggcctatgatctggagtcgacaagaggaggaaatttatatgacaactaacgtttcaaaagagtttgcgaactgcttgcaaaagctgttcccaggcgagatcttaacgctgattgacattgacgcgacaaagttcggcgggcaggtctaccgattccacaacgagaatatcgcctactcaaccgaagaacttttggcggcggttaacggcggcacgctgacaccgaaggcgatcacgtttcgcggtgagcaatacggcccgcgcccgttcgggatcggtgggattgcaatgtcaagtgacggcacggtagaaaagccaacgctgacggttagcaatattgatgcgcaagcgagtgctcttattcgcgcctacaacggcctcatgcaagcgaaagttacggtatgggttttggtcaaggatttactgaaagaagatggtagcgtcgctgagggagattttcggcggttcgtttactatattgaaagacctaaacaggttgccccgcagaaggctacgtttgaactaacgtcagtcttcgatatggatggattgatgatcccggcccgccagactcaaaccgtttgttattgggcgcaacgcggctggtacaaaaccgggaaggggtgcggctacaacgggcaaaacggatactttgacaaattaggaaatagggtagatgatcccagccaggatgtttgcggaggtcttgtttcgtcgtgccgattgcggttcggcaatgaggctttagattttggcggttgcgctactgcaaccttgaaaagcggacggtaatatgttaactccaaaaatcaaaatgcagatcatgcagcatgcgaaagaagtttacccgtatgagtgcgcagggctggtgacgcagaaatcacgcgtgcagaagtatcaccgactcgataacgtttcgccggatcctgagaacgaatcaatgccggacgaaacacagtacgcgctggcgtcactggaaggcgagccgatcgccttcgttcactcccacactggcgacggggcaaccaccgttccgagcgccacagatttatgcttctgtgatgaatctggcttgtcgtgggttattgtgtcgattccagaaggcgatatgcggattatcgagccgaagcgcaggccgctgattggtcgcccctgggctttgggcgcttatgattgctacggcctggtgatggattttcacaagcgccacggcgtcacactgactgaccgacgcctgccgttcgaatggtggaagccggaatacaaagaggatctttaccgcgactactggcgcgaagatggattcatcgaaaatactggcgatccagaagtcggagatatgatcatcttccagcttcaggcagacaagtggaatcacgctgggatttacgttggaaacaacaatatcctgcatcacgccttcggcaagctatcccgccgcgatatctattccgggtggtatgagcagcacaaggttttaatttgcagacataaggatcttaaacatggcatcacatacaaagacgattaaactttccggctcccttgggcgtcggttcggtgtcttccataacctcgcagtcgattcagtcggcgaatgcattcgggcgctatcctaccaggtggaagggtttaaagccttcatgcagagcaaggttggttctaacatgcgctttggtatcgtcgcggacggaaaaccaatcagcacgaatgactttgcaacgttcgctgtagcgaaggagatccgaatcatccccatcccgaaggccagaaagaacggcggattgttgcagatcgttatcggcgctgcgattatggttgcggccttcttcactggcggtgcatcgctggcggcaatgggggcgttttcatcggcggcgtttatggctggcggcgcaatggtcttgggtggcgtaatgcagatgattgcaccgcagatgggcggcaacatgcgagcgagcgagtcgcctgaaaataaaccgtcgtatgctttcggcgggccgattaacaccacggcggctggttatccaatccagttgccatatggttacagattggctggcggtgcgctgttcggttcagggtcttacgccgaagataacaactaattaagcgattcgatttttagcctgggggcatatcctccgggctttttgtcgtgtacaattgcaaaactattaacaggaggctaaacgatgactaatatcaaggcccgcaagggcggttccagccagccgcgaactccggtagaaatgcctgataacctgatctcgaaagacaagatcaagttattgctggccgtttctgacggtgaagtagtggatgacttcagcctgaagcagttgcatttcggcggcgttccggttcagaacgaagacgggagctataactatgagggagttattgcagaatttcgccctggcacgcaaacgcagagttacattcagggcttcagtgaatcaagcgctgaattccaggttgcacgcgacgttacctttaacacgccgtacacgctgacggtatcgaacaagaatctttctgctatccgcttccgcctgttatggccccgcgtgctgacgcaaaaagataacggcgatatggtcggttcggtcgtcgagtacaagatcgatatggcggttgacggcgcgagctatacgacctatttgaccgacagaatcgacgggaaaaacacgactggcggttacgatcgcagcatccgcgtcaacttgccgcaagacttcacgtcgcaggttcttatccgcgtaagccgaatcacgccggacgctgacggggtgaaggtggtcgatgccttccaggttcagtcctacgctgaggtgatcgatgcaaaattccgctatccgctgacggcaatgctttacgtagagtttgatagcgatctgttccagaaccagatcccgacaatctcgctcaagaagaagtggaagattgtccaggttccgagtaactacgaccctgttaacaggacgtatgccggaacgtgggacggaactttcaaatgggcgtggagcaacaacccggcctgggttctttacgacctgatcatgaatcagcgttatgggttagaccagcgcgagttagggatcccggtcgacaagtggtcgctctatgaggtgtcgcaatactgtgatgagcttgtgccggacaatcgcggcgggatggaaccgcgttacctgatggatatggtcgtgcagtcgcaggtcgaagccttccagttggtcagggatgtttgttccgcattccgtggaatgacgttctacaacggggaaagcctttcgattatcgtcgataagccacgcgatccggtttacctgttcactgctgataacgtcgttgatggcgtattcgtgcgaacttttccgagcgaaaaaacgatgtacacgtcgtgcaacgtgatgttcgacgacgaagagaaccagtacgaacaggacgttgaaccagtattcaacgctgacgctgcaatgcggttcggtcacaacccgacaagcatcacggcgatcggttgcaccagacggacagaagcaaaccgccgtgggcgctggattctgcaaacgaacctaagcgcaaccaccgtttcgttttctactggcctggaaggcatgatcccgtcatgcggcgatgtgatttacgttgcagatccgcattggcaatcggcctttaacctggtgttgtcaggt

SEQ ID NO: 15 - DNA, 143013 bp, Unknown
  bacteriophage genomic DNA
atgtctgctacattcgcaccagcgagtcgaaagcaacaaatggttctcgaatctgacgcacaaataatggttatcggtggtgcagcaggatcaggtaagtcctacctgctccagttgatgcctttgttgattgtaaacgaccccagaacagcatgtatcatgttccgtcgtaccgtccctcagattcgtggacaaggtggtttgttcgacaaagctaaggatatttacaaccaactacctccggtagttaagcctaagtttaaagaaaatgaaatgactgcaacatttcctaacggagctaccgttaaatggcagtctatgcaacacgtaagcgataaattcgatattcagggattggagtttacctttatcggagttgacgaaggaacacagttcgaatgggaacagttggaatatatgatgtcccgtttgcgttcaaactcaaaatatccttcccgtatggtaataagttgcaaccctgatcctgatcattaccttcgtaagatggttgactggtatctcgataaggatggctatcctaatcctgaaaaagacggagttattcgttatttcgtccgtgtggatgaccaatacatgtggggagactcagtagaggagttgaagaaacgttatggtaagaaatgtaagcccgtatcgttcacattcatatcttccactatttatgacaacccgccaatgcttatcaacaaccccgaataccttgctcagttggaaggtcttaacgaggttgaccgtgcacgacttcttcatggtaactgggatgctcgtccgcagggtgcaaactattttaaacgttctttcctcaaaaatgtagatcatctcccgcttaattgcgacaaggttagatcttacgataaagcaggtacagagcgttccacaggtaacaaaacacctgacttcacggcaggtataggtgtagcgcgagatcaggatgggttctactacctgttcggtgattattgtgatgaattcgttgatactggcgattggtccactggacaagccggacgcttctgcaaaaaagcaggtgagcgtgacaagattattcttaaacaggcaatacatgacggagatgacgttaggatcatcttccctgttgaccctggtcaagcaggtctatccgaatttactacatcttctcgtgagttattgaatcaagggttcatggttgagaaagacccaacaccaggtaacaagaagaagcttgtacgcttctctccgttcgctaacttagcacagaacggatttgtacggattgttgagaaatcttttcctatggacacattagaagctttattgaaggaacttgaatctttcgacggtgagaggtcaactggatcacgtaaggacgactgggtggatgccatctcttcgggtattaactatctggagaaaacagaaattgtccgtgctgttccaataccacgacctcacgcccctacgatgtattccaggtatagacgataactgaggggaattattttgaagaagaagaataaaggtcgcaacacacaggttcgtaaagcgacgagcgaagaattaaacgttgctcgtttacgaataagtgagcaaggtacttttgctttagctaaggttcaggtagaaactgaacgcatgaaagctgaagaaattaaatggcctcaattgatcggtacagttgaagctatgaaacaagatgctacggtagcgactggtcttgatatgctttacactttcgtagagaaagcattcaaggacttcaaagtaatccctggcaaatctaaagagtctcaagacgcagcagagttcattaccttctgccttcgtaacatggaaggtcaaaccctgcgtcaatttgcccgtgacgctgccacatttaacgaatacggcatctctgtagttgagaaggtatatactcagatccagactggtgaatatgcaggacgatttaagattaaaaaccttgcattccgtccacaggcttctctgagtcgtaaaaaccctctcgtgtacagcgatgatggttctcgtgttatcggtgttaaacagtcacttgattctttcaagaactacacagatagtccacttggtgcttctatgagtggcctgactggttctcgtagagggaatgatgttgttattccagcaaacaagctgatgatcatgacgactggcggttcttcttctcaagcactcggcgtttctccgctggttgcttgttaccgaccttggcgtgaaaaagttcttatcgagaaccttgaagttgttggtgctacgaaagacatgggtggtgttatcgaactgaagattccttctgctattcttaacaaagcagctatcgacccttccagctacgaagctgagatggttcaaggtctaatgatggatgccgcaaacgcccactcaggcgagcaatctttctttatgttaccgtctgacgttaaagataactcacccctgtattcaatgtctctgaagggcattgacggtatgggtaaacagtacagtactcgtgacctgatcagtgatcgtaaaaaatcaatccttgatcgtctgggcgcgggattcctgaacgtaggtaatgatgcctctggttcatacaacctgtcggaatcaaaacaaactatccatactcaatttgtacaacgtgttaatgaaattatcgctgaagcactgaatgaaaacctactccctcagcttctggctctgaacggtattcgtctggcagaaaaagaaatgccattcgttaaatttggtcagatcgttgatacagacatggaaggtttctctaaagcggttcagcgtatgggtgctgtcggctacttgcctaagacaccggaagttattaatcgcattcttgatgttcttggaatcgattatcaagttggtgaagatatttcgcaagaagaacttatgcttctccttggagataataccagtcgttctggcgatggctttgcacaggggacttctggaaacgggactgcaaagattagcggaacaagagataattcagtttctaatttagaaaattgatctttgatttaaatcagactcttgcaaaacgaatcgttcagtgttaaaataaatatcacgggagcaatgatggaaaacattactatctccgaccttccttcacaaacctatctgtcccgaatccaaaagggacgggctgtgaaaaaggccaatgagctacttaaacagggcttcaataaagaggcttctatttctggagccattggctccgttcttgtccaaaaagctgcacagaaagaagagatgatttcttacgagatcatttacgaacctgatacgccggatgctcatggacaatggatgagcaaagagacactagttaaagcacagcaagatttcaagaaagctcaagaaatcggtgcggtaactgagaacttgtaccacttggttgataccgaagcattcaagatcgtagatcattggattcagccagaaattgatgtaactgtcacacaaacaggagaaatcataaaagcagggtcatgggtagcaaaggttcaatattcacctgaagcatgggagttaaagaaagctggcatcgtcggtggattatctcttcagtgcggtggtatgttgaatgaggaaacaaatgagctatccgatcttgatttcagtatcgaattggaagaggaataataatgattaagacccttatagagaaaggtcgccagattaaatctcgcggaattgctctaactcaccgagatcaaggctacagtgcgaacaatcgacacgtaagcctcctcactaaatctgacattgacccaagcaaactgacggttgatgttatcaaagctcttgagcaagttcaagtaactatcagtatggaagagttcttacgtcgcttcttccacatgtattacgatgatgcagagttacttactaagctgatgggcttcacaactacctttgaagacgaatacgcggataaagaccctgaagacttggattcttatactgctgattacgttaaacgtcatcaagaatatctcgatgaaaaactcgaaactatctccattatcaaaaaagcaaaagaaggtgaagatctttccctgatcgaacgctttgagttaattaagactcgtaagcaattcgaagacggttgtaaagaattagctttggattttggtgatgaatctgaattacgcaaaccagaaactggtgaagtagttaaatcagctactaagcctgaacctgtaagctccgctggagcgaccacaaccatcaaggagactcctgtggaaaaagaagtagatgtaaccaagtcccaacaattcattgatctgatgaaagctaatgaagcgttgatggctcaggttgaaggtatgaaagaaaccttcaccgctgctcaagaaatcgttaaagctcaggctgttgcaaaacgtgaagttgccttgaacaaagctgcaagttttggttttgttgctgatgaccaacgtgaagctgttgctgacctgatcgaagacccagctaaagcatctgttgttgctgtgctggaaaaagctgctgctgctcttaaagagaaagacgaagctctcgtcgctaaagatgcagaaatcgaagagatcaaaaaatccttcgctgacggcaaagaagtaggtgctgatggtcaactgactgaagttgctaaaggctctgaagacgctcaggctcgtttgaaccgagtaatcgcagaacgtgcagcagagatcgctaaggctgctaacggcaatgctgaatttattaacgcctaattattgaggaaacgaatagaatggctaaagcacatgttgtaactctcgaaggtaactactctgatatcgtactgggccgtgttgttgcatttggtgacactggttggaactttgaagaagtagaaatggattatactgctgatctggtcgcaggtctgctggttaaagctgatggtactccggctgctgttgcagacgctgctgacgtttacggtgttctggttgaccgtaaagttctgcctggtgttaccaagcatgacggcgctaccccgatggctggtgagaagcttcctatgactatcgctgttcgtggtctgaccctgaacgcaaccaaactggtctacgctgacggtactgcaattgacgctgctggtcgcctagctctgtctaaagctggtaaccaagtaactgatcgtgtagtagctaccgaattcctcggcgctgtcctgtaactttttcgaaggagaatatttaaatgcaaaatggtgattttcaaatcctggattacactggcctgatctctactctgccgcgtgttgataccctgcttcaaagcatgaacctgttcactgagaactttggtcgtactactatcgctaaaatcgaacgtcgtgatgacggtgctggtcagatcaatgctgtacagcgtggtagcgttcgtcagcacctgggtaatgatcgtaaaaagatcgtaaacctgaacatcccgttcttccctctggaccgttctatcgaccgtgcagacattcagaacttccgtgaattcggtactgacaacgctccggcaactgttgaagctgaagtggctcgtcacttggcccgtatccgtcgtagtcatgcggttctgaaatccaaggcaatgtacgctgctctgaaaggtacttcctggtcccctaacgatccggtttgtgattacgactactacgatgtttgggatgtaacccagcagactgctgacgttgacttcaccgctctggctattgacccgattgaagtgctggaagctgaagctcgtgcacacatcatcgattacgctggtgaccaaggtgacaactacgagatcgtcgttatggcatcccgtcagtggttctctgctctgatcgctcacccgcaggtaactggtgcatattctcagtacccttctactcaggaagtcctgcgtcgtcgtctgggcggtaatgccaacaaccgtatcttcgaacacaagaacatcctgttcatcgaagacatttccggtaacatccctgctggtgaagcatacatcttccctcgtggtatcgatcgtatgttcgaaatctattacgcgccgagcgacactctggaaggtgctaaccaagtagctcaggaactgtatgtattcttcaaagaatctcagtacctgcgtgaagcgaagatcgaatctgaaacttccttcctgactgttaacaaccgtcctgaactggtagttaagtctgttggtaagtttgagtaatcttaataactaattaaaggtcaccttcgggtggccttttttattatacctgtacaatttaaccaaaatagtgtaccattataagataggctattaatctgatcaatgacgaaggagttatttaatgtctaagcaaactcacttggaagtctttaagagtgaatatcacatgctcaagttctttggtgaatatcttgaaaaacttgatgtaaacacctctgcacgtttaggtgcatttctttatagctacgatggaaaactggttctggctcgtggtctttacgatttcctaactcaaatggaaaagatgacggctctcggcatcgataccattgcgtctgcacagaaaggtacaagcttcttagtgttctttaaagagaagcctaaagatcctttaaaattccgcttggatgctaagaaaatagaagctgttaaagaagctatcgttgctgacacaccctctaaagtaatggaagattctgttcttgtcaacactaaagttggagaagaagttgaagtaaagacagaattatcttaccgcactgaagaagaaaaggtacagatcttagctaaggctgaagaactgcgtgatgacagcaagaaggctgcatcaaaggctgcactggaagctttcgctgtggaatacggaatttcactgagcaaaggcaaaacctttgatggtatgatcgaagatttatctgctgcactttaatccctccccatgcccctattcaggggcttaaatccctaggagaattttataaatggctgaatataatgataaggtcgtggaagcatttgttactgctcccgatcctgtcgtaactaccactggtggtggagttatttttaatggtattgaaactgaagatactgtatctaccctgttgattggtgatggtactgcgtcttcccctctgcaagcccaagttaagctctctcgtcgttccggtaacgccctgactatcgttcagacagacaatgagcaaggcttgttcgcctctgctggtgatgctaaagtatcaacttctccggctaacattgcaaaatacgtaactgccgaagaagcagcttcacagggtgacgctggattggaaggtgttttggtagagccagttcatgcaaccaccaccgctgttggtgacgcactggaaattaccgctgatcctctggctgctaaaaaatcccgtattacactgaaagtttccccttctacaactaacgcattatctgtagaatccgatggtctggcagttaaagtctcacctgctatcgacaacagcctacaagttcgtgaaggtgctctttacgtagctccagttggtgctgacatttctcaagatgcaggtaacaaactggaacaacgttcagatggtctgtttgtagagactatcaaaggcgataagggtgatcagggcgagcaaggaccagaaggtcctcaaggcccagccggagaaactggacctgctggcccgcagggtgaaaaaggggataaaggggatactggagaagtcggtcctgctggcgcaactggacctatcggtctgactggtgcaactggccctcgtggtgtagaaggtcctcgtggccctgctggtattggtatcaacatcctcgacaccttggcatctgaagatcaattgccttctgttgttgatcttgcgaatggtgatacatacgtaatcggacagagtttctttaccgttatcactgaaggtggtatcaaacaatggagaaacgtaggtaacttcgctggacctgaaggtctttctgcatttgaagttgctgaaaccgcaggctttgttggaacagtcgatgactggttggctacccttcgtggtgctgacggtataggtctgcaactccttggttctttccagcgtatcgaagatcttcctcaagaagagaacaaacctggtgatgcctacatcattcaagaaaagatgtatgtttggactggtgatacagatggctggcaacctgtaggacagatcggtcctgaaggtcgttctgcttatcaggtctggctggctaacgggaacgtaggttctcagcgtgaattccttgaatcactgaaaggtgagaaaggtgatactggcgatcagggtcctcagggtatcccaggtgcagatggtaaaaatgctaacgccattaatatcttaggttccgttgcagatcaggcgagtttgccagaaggtgcagatgcaggtgatgcttacctgatcggtactaacgtattcgtttctgatggtgctggcaactggcaagacttgggatctttccaaggtccgcaaggtcctactggtgctaaaggcgacaagggtgacaaaggggacaaaggggacaaaggcgataaaggtgatgacaactatgccatcgcagttgctaacggtttccaaggatcagtaaatgaataccttgcatctatcaagggtgagaaaggtgacgttggtgcaactggccctcgtggattagctggtccacaaggtgaacaaggtcctgttggtgcgggtctgaatatccttggctcagtagcttccgaagaccaattgcctcagactggtattagtgaaggtgatgcttatctgattgaagctgatctttatatcttcactggcggtcagtggactaacgttggtaacatcaaaggtccccaaggggatgtaggaccacaaggtccacaaggtcctatcggcttgactggtgcacagggaccgcagggtgcaacaggagcacaaggccctgctggcccacaaggtgagacgggtccacaaggtggtatcggtccacagggagaaactggagagaaaggcgataagggcgataaaggcgacaagggtgatatcggaacgggtatcgtagctcgtggcgttgttgcaacccaaagtgcacttccttccggcgcagcacctggtgatttctacgttgtagaagatgaaggtaacggttacgcttgggacggtacagcttgggttttaactggattagctcgtggacctcaaggtcttaaaggcgataccggagaaaccggagccaaaggtgataagggcgataaaggtgatgcaggcgatgcacttaagctgagaggcttggttgcaacttccgctgaactgccttccactgctgaacttggtgacttctatgtcgctgaagacaccggaattggttacgcttgggatggtgttgctttcgtttctgccggaaccgttagaggaccgcaaggtgaagtagggccgcagggtgaagttggtcctcaaggacctcaaggcgagaagggagatgctggcgagcaaggtcctcaaggattggtcggtgaaacaggtgcaaaaggtgataaaggagataagggtgacgttggctctggtctgattccgagaggaactttaccatctcaagcagatcttcctcaaactggtgaagttggtgacttctacgtagctaacgatactggtattggctatgcttttgatggaactgcattcgtagaagctggcgttgcccgtggtccacagggtgaacaaggacctcagggtgaacagggacctcaaggtcttaaaggggatactggtgaaacaggtgctcagggacctcaaggtgttcaaggtgagaaaggtgataccggagaacgtggagaggtaggtccgcaaggtgatcagggtccgcaaggtgagcaaggacctcagggtgatatcggaccaggtgtagagatcattggacgatttgatacctctgatgaattaccttccacgggtactttgggtcaaggttaccttatccaaggcgacttctggggttggactggtgcagcatacgagaacttgggtcgtattcaaggtccggttggaccagtaggtcctacgggtgaccaaggaccacaaggccctgtcggtaacaaaggcgataaaggcgaccaagggaccctttgggtagtttttgctcgtgcaccaatggtgagcgatggtcgtgttaacgatctgtacctcaactcttccactctggaatattaccgtaaaacttccgcaacgaactgggcactgctcggattcttaggtggtggtaacgtgtatgacgcaccaggggacggaaagctgtatgtccgtactgatggtggttgggttgaattacctaccgcagaagttctggaagcacctcgtgatggtaaccaatacgtccgtaaagacggcgcttggacaactgttacagttcctgtaacggaagcaccacttgaaggtgggttctatgttcgtgaaaacggcgcatgggttaagctggaccagtacgatttgcgtgttgttgcttctacaggggcaattgatgcaagcactggtaacgcttggactttagatgggactaccaacaaatccttagtcatcaccggattgccagcaggaagggctaaaaccatagtcttacgattcactggtaacggtggtcagattaactgggatagccagatcgcttggtctaacggaacagcacctactctcggggctactcgcactatcctgaccttgttctgggatggtgagttcctgacgggtactcaagcaatgactataggttaatttttaaatgggggcttaggccccctctttcagaaaggagttaatatggtgatcgataagatttatggctggacccccatgatccgcatgtctgacatgcgttatccggtatacctagccgactaccgtgctgaatatcctaacgtatctattggtagctttgtttacgctgtcggtatggctgaagttggatatcatgcggtttatgatgtaccgatgccgcaaggggatgttgtgacggaaggacttccagaattgcgagaagacggtttctggtacagaacttggaacgttagggattttaccgaggaagagttagctgataacttgactcgtgaaaaagaacaattaatccactctgccaaatctaatttcgaaaatgaaaacatgggcggcgtagaggttgatggtagtttctattctgtagattcaaattcactgtctctttatcactccattctttctgttgcagaactggctgaagacgatcaattatttagtctgttaacttacgataataaagtgatcgagcatcttcgtctagatgtaatcgaacttatcaaagaaataatctccgtttatgtggaaagttacaataatatggggacttttattaaagaagtgaatattgcaaaaaatatggaagaacttccttccgtacctgagtctttccgcactgcttaatagaggtaatctatgcctacactagctcgtggtatcacaggagatcaaaaagggatatactacggttatgccctttatgatttagaacaaaaacgtaaaataccgttcaaggatcttttcggttctggtggcggtcaaggtgaagtcggtaaccaaggtccacgaggggagcaaggcccaatcggtcctcaaggccctgctgggcctgtaggacctcaaggtccgattggaccgataggaccagtcggtcctaagggtgatgagggtccgagaggacaaaagggggagcaaggcgataaaggtcttgatggtgcagatggccctaagggggataagggagacaaaggcgatcaaggatccgttggaccagaaggtcctcaaggaccgcagggagaacaaggtcccgcaggtgcgactggtgcaactggaccaactggtcctatggggccagcagggccacagggtcctgtagggccaaaaggggataagggagaacaaggtcccgcaggtccggctggattagattggaaaggtgactatgaaccttctgcaacttatagtgtgaatgatcttatctcttataatggtaaagtttatttcgccattcaagagagtacaggtcagtctcctgatactgttggaagtgaatactggacagaattagctatccagggtggaaagggtgatcaaggggaaactggcccagcaggacctactggtccacagggaccagagggtcctcaaggaccttccggtatgccaggggctactggtccacaaggacctcaaggacctaagggagatattggaccagagggtccagaaggccctaaaggcgatactggagatcaaggacctaaaggagacaaaggtgataagggtgataccggaccggagggaccacaaggtcctattggtcagactggccctgctggccccgaaggcccacaagggaacataggtccagctggtccgcaaggaccgcagggtgttactggtatgactggagcgacaggtgctgtcggacctcaaggcccacaagggattaagggtgataaaggagataccggagaacaaggaccgcagggtgaaaagggtgaaaaaggtgacaagggtgatacaggagctacaggtcctaaaggagataaaggtgaccgtagtatgtattattataaccagactgtacaaacaccttggtacagagatggtggtcgtatagatcatcgacttccaaatcaccctcatcttagtatttctgttactggtgtagcaacagacactactactggaggtgggttgcaggtaattatcagtaaccttgcaaatgctgatcctaacggcagagatgttaatggtgcttacttctacaaccttacagatgcggaagtcccaagccgcagtagaattcaggcgggaccttacacatggataaaaactaatggtgcttactatgtaactacagatgttgaacctatgaatggtagacgtacagttttagagatcgatatatctgatttcgacaccaagcagacgtggcattgtagactgtattcaagtttcccagcaacctcaccgactgaattaggactctatactatagagataagagaaacttcagctcacccttaattagattatgattcacaaggatgtgattaggaggtattatgacgagttctgcaacaggtatggcaggtcacaacagcggtatattttacggatacgctctatatgaccttgagaagaaaagaaaaatactctttgaagatttaactaagggagaggcaggccctcaaggcgaaaaaggagatcccggcccagaaggtccccagggggttgctggtccagaaggtcctgttggacctcaaggattatctggtgaacctggtccgcaaggaccgcagggagaggttggtgaaaccggacctcaaggccccgagggtcaacctggacctcaaggccctcaaggtatagagggacctgtcggccctgcgggaccccagggtcctgtaggtgaaacgggaccaatcggaccgcagggcgagaagggcgatcagggagaggttggaccaaagggggataaaggagacaagggagaacctggtggtgtattcagctggagaagacaagcactacctgctttgaacatgtcaatggacacaccctttccgagcacaaacaatacttggtttaggattaaatctgacaacgcaacaagagtaagttttttcgttactaaaggcaattcaacatcccatggaacaacatctgtggatggggagataatttatttcgatgcggaaaatgcagtaagacgtataggttttaacggcacagcatcgactgatagtgactatagaatcacaactgacacttatgctgtgttatcaactagggttataagattaaatatttatctctccgaccctgatgcttattatatttgtgatatctttatttcaggaatgccaagtttcacatctacaactcaagcggattgtacagtaagaatacaaaggcttgatgcataaacactggccctttttagggcctttcttcaatactcttaggagatttttatatgccttctacagccaaaggtattacgggagatcacagcggggtttatttcgggactgccgtttacgaccttaatgcaagaaagaagtatttgtttaaagatttgttttctcgcgtcggagaacaaggtgacgttggtaatacagggccgagaggacctcaaggcgaacaaggtccagctggcccagctggccctcaaggccccaaaggtgacgttgggcctcaaggacctattggacctaaaggggatgagggtatccgtggtattactggtccgaagggtgataaaggggatcagggtccggcaggtataccaggcgcagctggagttgctggccccgtgggtccagtcggcccacaaggtccgcagggggttcaaggtgaacaaggccctcagggacttgttggaccagaaggacctaagggtgaaactggagctgaaggaccacaaggtccaatcggacctattggacctaaaggggaaaagggtgatgttggaccagcgggtttaactttcaaaggtacttgggacgctgaggaatcttattctgaaaatgattcagtttcttataatggttcaacgtactttgctagttcggctagtattggctcagaaccaggggaaagtgaagactgggttgtcttagctttagaaggttctcagggacctgaaggtccacaaggccctcaaggacctaaaggtgatcaaggatcaagaggcgaacaggggcctgtcggaccgcaaggacctcaaggtccacaaggaattacaggggctgtcggacctaaaggtgatgaaggggcacaaggtccacaaggtccacagggtcctcaaggacctaaaggagatgttgggccagttggtccgcaaggggaggagggtccgcaaggtccagttggaccgattggccctgaaggtcctcaagggaatacaggacccactggtccacaaggacttattggacctcaaggacctaaaggagatcagggaaatatgggacctcaaggccctcaaggacctaagggtgaccgtggagatgttggtcctgctggccctcaaggccctcaaggcatcgcaggtccacagggaattcgaggttctattggccctcagggggaaatcggacctcaaggccctcaaggtatcactggccctcaaggacctaaaggagacaaaggtgataagggtgaccgtggagagaaaggagaaactggtgcaactggccctcaaggtccagcagggcaaaataatacaaataatccagtttatacaactcaacttgccgtatccacaagctactcagctatagccataccaaataatccaggtgtttcttttacaatcaggaaggttggcaataacattgaatactcttttacaggcaactcaattgcaggaaggtattttgatgttgaggttgtaaactttccatctgctgacgtagttaagagatatcagtcaaatcacacaattgcaggaactagcaggtatgttgtaggtgatcctgcgggttatactggtggaggatataaaaggattcaattctcagctagagattggggagataaaaacattataatgattgatgtttttcatcttcagcgcccatctgatactagttttaacatcgccattaggattgagacattcaaactcccttgataataaaagccaccctcgggtggctttatttttatacaaatgactttctttttattttatggtaagatgttctaatacactggaggaatatatgactgatgaagaagtagtacaacttgtccgtaactttttaggtggacttactgaagatgaaatgcctgacagcatgattctgtttttctataataaatggaagatttgttacgacctagaaaacaggccggatcagttctccatcattctttacaataccgttcttgattgtgtacgttggcttattgttcaggaagtttcaagtggtgcttcttcaattcgtgaacgattcgaaaaagtcggcgatgaaaccatatctgtgaaatacgggtctaactctggaaactggcaagactttctcgactggttgactgagcatcctgagtatattgacccgtgccttaaagacaatgccgtaggttctggcctcggtttgatcattatcggtggaacaaggaagggtgaatttgcgagagttaaaataaatcgggattccttcaatggattcatggagccaggtattttccctgctgtgggtacaagaactggtgtaagaaagcgtaatccttggatggtcaactaaagctttgactttgttgcttttgctcatctattgtggtaaaataactttcatggagaaataaccgtgaagaaaacatcaacagttgatttttctgtcatggatcactatttcgaccaactctctgaattggaaacaaaagagattgaggtgggcttctttgatgaggctcactattctggtctaaatatggcgactcttgcagcaattcacgaattaggatggaacaatcttcctgaacgtaacttcatgctttctacttcgattcattatcgcggtggactcatcaagaacctcaaacggcttaatgatgatttgctgaaaggtaagtcatatagccctgcactcaagaaaatcggtaaggactacgctgacagcattcgttttacaattgatcaaggtacgttctctaataaccgagtatccactgcatgggcgagctataaaggattcagtgatgcaatgatccattacggcgatctttcagatgcagcgaagtttaagattgttcctcttacgaaagactaaggaggcataatgtctcgtggctatttattgttaagtcgtcgcaaccaacttatccctcgtgtcgaggttgaaggtcgcagacgttcttataaaaaggttgatttggatgacccattcgacaacggtggtctggaaattgaatacacaccatttacggctgttgagtgtgtcattcaaccaatccgaggcaaagcgcttcgtgatcaaaacaaccaactgactacagcaggtgaggaagattacgactcctatactgtgtattcagaaactgtattgtatcgtgcacaagaaggaacggataaactttctgatcaattgtggcttcccaattctgttggtgagaacagttggtttacagtaatgaaagctgaccgttatccaagtgcaggcaacatgagatatcgttactatctgatcgctgtacctgttggaacagagggtggattataatggatcaattgcctaatgagtttactaactccgacgagattatgggcaatctcacaaaggttatcggtcgtctcttgaaagacgtaaccacttacaaggtggttgaagctggtgaaacaatccctaaagttgagggaccattcatcctcgtagacctatcagatttaagccctctcgattgggaaacaaatcagattgttgagaatggtatcacccacactgttcacaactacactgcaacatacacactcaccgcatatcgtggaaaacctcactgggcattgactcgttttcatcaggcattgagccttgcatggataagagataaatacttccctgtcggatcaccttatgcttactcgtccacttcttctattgcaagattaagaattccccttaatgagcaatattacgaaaacagggcaagggtactgattacctttaacgttacattcgttgaaagtgacttcggtcagtttgaaaatatcgaaagcatcattatcgacactagtgtttcagatccctctggaaacaagatcgaaaatgaagcccttatcgatatcaacgtcaaaccaggtggtgatggtcctagtatcccgccagaaccggatattcctttcacttacatcgatactatcgttactgtaaacgagaagtaaatccggttattgataggcccacgcttatcagtgacaaatgaggggcttcggcccctaatcaattggcacttccggtgctagtcaataatcgtctagaagcagaggataaacatggcttatgaagataaggtagttgacgtcgaggtaactcttggcactcaacctattgataccgtagggtttgaaaccccaatgttcttagcagtacacaacaacttccctgaacgtctccgtctgtacgggtctttggaaagtctggttggtgatggatttgcagttggttccgcagcgcatcagtttgcatccaatgcatttggcggttcttttgctccgcaactggtggctattggtcgtatgtctatgtcgggttctcgaatcgactttactggcactaccaataccgaacgtgttgttgtaaatattaccatcaataaggttgttaaagcaatcaccattttggttaacgttggaaacacccctggtcagatcgcaaccgctctggcagaaggcattaacaacgatgcggatttggctggtcgcgttactgcaactgttgaaggaagtacagtcgtcgttgtacaatccgcagaaattatcagcgtagggaaaggcgaaggtaattacaagattgtaaacacctctgttgaaactgttgcaactgttcttccgcaggtacttgctgaaaaccacaactggtacttcctgtctcacgaacaacgttctgatgcagatatcgttgcagcggctgaatttgcacaagctaattacaaactgcacgtatataactccagtgacagcgatgctctggcagcagctaaccaaagcgcttccgtgtttgatacactgaaagctctgggttacaactctctgggtacttacgacaaagaagcggatgtagaattcaccgaaggttctgttatcggtgcaatggctgccaacgatccttcttacggtgactctattcacctgaagacaatgcctggcatgaagccttctaccatctccgaaactcagcgtagcaacgcttggggacgtaacgcaaacatctatcgtgcaatgtacggcactaacagctacatcgaaggtcgtacctccagcggtcagtatgttgacgttattcgtttctcccattggctgaaattccgcatggaagaatctgtattcggatacatgaagcgtcgttctgatcaaggccagtccatgaagatgagtgatgaagatcttccggttctgcgttctatcctgttcaacaacccaatcaacatcggtattcgtaacggtggtattctgactggttatgatacagtgaaccgtgtgagctacgatccaatcattactattcctcgtcgtgctgaaattccaagcaacgacttggctaaccgtatcctgcgtgatgttaaagttgaagtagtttacaacaactccctgcactacgttaaaattcgcgctgctgttgttctggatcgtcctcaaactacgacccaaagcactcagacttctttcactacttcttctgtaggggtgtaatagatggcactgaatcctaagttaattagtctccaggcgtatgacccagccaaagtcctgatctttatcggtggtcaacgtgtttctggattcgccgctgatacgaaagtcgttgtttctcgtaacaatgataacattactccgctgtcgggtgtagatggtgaagtgagttctgctatcgtccgtgataactccggcgtagtgaccatctctttgcagaatacctctgtatggaacggttatctctctcaatggcagttgcaagcccgtcttaccggacttgtttacttcccgattcagattgaaggttctcagggtctatctctgaacaccttcggatggattcaacgtcaaccagacctgacctacggttctgaagtaggccagatggactgggaaattggcgtagtcgatgcacagttgagcgctgatcagattcaaggtgttgctgctggtatcggtggaatcctcggactggatcaataattacgtgagcctcaaggatgaggcccttctcacgctacggacatatttatattaacaaagtggacacaggagtgtaaacgtgcaaggttttaaatttaaaaagactacagagatcactctctgcggcggtaagcgattcacgatttatcattggtcgcctactcaagttatccgtaatatgcctaaaattggcaagctggtagctgttcctctgggtacaatggcaggctctgctatttccggtggacaagattttcaagatgctgtcccaaccgcaattctttatattctggatcgtatcgatgaaggtggtctggaaattatcaaccttttactggaaggcgttgaagtagacaacatgggtggcccgattgatatcgatgaagtgtttgatggtcacgtagaagatttgttcaagttacttgctgaaatcatacaggtgaactacggctgttttttcggcaagagcggtttcgggacaatcgaaaatctccttcagaagttcggtctggttcgcaaggtggaccaactggatcagacggaagcctgaggccgctgagtacggtggaaagggccttggagtattgtaggaaaaactccagtctgaaatggtatgactatctttatttccgtgtcatggagaaattcaagggagttaatgaactttctattgaaagtggggacatggaagaccttcttaagaaaaatgaatatatagatattcaagaatatttggaaggtgttcaagagaaagagaaggaatacgaacgccagcgaatggaacaacaagaggcccagttaaaacggagaaagtaaataaatagggctggagtcgaaagactctggcctttatttttattatgaggagtcgaaatggctgttgaagtaattgcaacaacaaagaaccgagtcatatttgaaactgacaaaggttcctatcgaaaagctcgtgaggagatccgaaaactctccaacgaatggaaaaaggcttcaacagaggctaccgctgccggaaagaattctcctgctgaggcttataaacaatccgctcgtgaaatgagactagtcactaaacgtctggaagaaactcggaagcgtgaggagaagaaggccactgattatcgtattgctctggcaaagaaagaagccaaggcaaaagaggcaattcagaaggtttctgctgcaagaatacgacaacaggttaaaagcctgacggctgcatcccctggttctgctgagatgagaaagttctatcaggaacaggagaaagctgcccgtgctgctgcaagatctgcaaaccgtacagcgacacctttaccgcctttcaacatccaacgtgtggaagctgcaaatcaattattatctcgcggtaacagagagccagggtcaggtattgttggagatcctaatagccgattcaaccctgatttaattgctgcacaaaacagagcgatgcaacgtagttctcgtatcaaagagagaatgcagaagcaacaaactcaagaacaggaacgtgaacgtgtccgcgctgctcgtgctgctgcccgtattgatgatgttacagcacaacaacgtattcgtctatcctctcgatatggtcgtggttatgcaggtgctttgggtcgtgattcagagggtcgtgggattgaagatcttaatagacaatttcgtgctggtacgttatcatctgggcagtatcgtcaaagcatacaggcgctagaaagacaattccgtgctgcacagtcaagtgctggatctttctcttccacacttaaagatgttcgttccagcctggtaagtgctactgccgcatatggagttttctcagcaggtgcatcaataactcgtcaaggtcaattcttcgaaggaatcaatgcaacatctctgttgatctctgattcggcagaagaagctggtcagcgtgttaagtttgttcgtgacgaagcataccgtttaggtttggacctgaaaactgcatcgcagggatttacgcagttagcaatctctgctgacggggttatcagtaaatctcaaacagatgaactgtttactgcattttctgaatactcaactgcacttcaggttgaccctgtaagataccagcgtggtattacagcaatccaacagatccttggtaaaggtcaagtaatggctgaagaacttaaaggtcagttggctgaagctatcccaggttctttgcaagtcttcttgaaagcaactcaagaagcatttggtgacacctctatcgacattgcaaaattactaaagttgatggaagatggtgaattgaaagcatcaaagatcatcccattagttggtaaatactatgcagaagctgccaataaaggtggtgcgctggataaagctttggaaagtaaccgtgttgcttatcaacgcctgactcagacttttgcagaattccagaataggatcttccaaggtggatttggtgaacaactgacaagggtgttcaataacttagctactatcctatcgagcaatggtaacgttgcaagcaccatcggtagattcttcggtaacgtaattgaaggatttacagacatggttcttgaaatccacgataacttagttcttcttgatcgtgttgttacttactatttcaagaaaataggtgtagaaggtgaaactcttcgtcaagtattcgactggggatcttatcttctcggtattggattattccttggtggactgaccaaagtgttcaacatccttgctaagattgcgggacttaaaggtgcgcttaaggaaattcgtggctcactcggtggtgacttagccacaggtggaaaaactagcacaggtgcaagcacaactgcttctggtggggcaggtacaccaggtcaaactagcgtagcgggtagattcagtcagcttggtaaacttggtaaactcttcggccttggtactctttactcggcagggtcagagatcaatgaccgctttatccaaagtggtgagagtcgcttggctggggccggacttgatgcaactgctttccaacagcaatatggtgtaacgccacaacctgtcgggttaacggatgtgttcagggagttgtttggtggctctcgtgacataactgtagatcctaacactatctcgactccatctggtattcgccctagcggatttcctctggaaactccagcagcaccacctgaaggtaagatcaccgttgagatcaagagtggagagattcgtcaatatatccgtgcaattgtggatgaagagaacggattcaatatcaacctgctcactcagggtggtaaccaataattacagggggcttcggcccccttttttattgtccttattcgtgttaaaatactgaaaggaggaaacttatggctactgatttaaaacctagtacttacaaaatgggtacgtattcacctgagcagattgctgctatcgacaaggcgtatcagcaaggtcaagctgaagaggcccgtcaaaaacagacggcacagaataccaagttgcgtgaagatgttcaatacacactcttcgcttctggtataaatacaggtagagcaccacttctttacgacaagaaccaaacagacgatattgctatcctgtttgacgttgttactacccacacctacacaaaggattataacaagaccagctatgctgtagagtcaaaagctaaagcatctgatcatgttgtaactcaagatggtaaatttagtttttcggcagtcatcactgactctcctttaattataaacgagagaaactatattgatttcgatacagacaaaaataacccgttacaatccaagcgtccagcaaaagctgtagagatccttaagcaaattggtgatggtcatcaacttgttaccttggtaacagaagatgatatcctgacgaactatgtgatcacaaacttctctgttactcgtgacaatggtcagggaggtagcattgctgttagtttgacccttgaagagttccgtttccgtgatatttctaaaacagttttagcaagaactactgctgaccctaagaaagctaagaatgtaaactctggtactaaacagaccgcagagaatggttctgttagcgacaacgctcaaggtaagcgtaaaacaccgtatctcggaaagaatgctgctgcaaaagagcgaatcgaaaacgcacttacaggaacgacagatttctctggagaggcaggtaagaaatatgaatttgatccagcatctttgaagaggtaataatgattgatcttaacaagaaatatgtgagaacattcgattttgaattgactggataccctgacgaaacattccgtgtggtcctcgactccgtaacttacgaggttcgttttacatggaatgaaagggatgagtcttggttattctctttaggtgatatcggtgtttctcctacgataactaccaaattgacttgctatagtgatattatcggaccttatcgttatttggataatgttcccgatggtaacctgtatttattcccattgagagatattgctactcgtgtgggtcgttataatgttggacctctttctggtgtccagatgatttatgcatccagagaggaagatgtggaggcgattaattaatgaaggcattggaaaggacatatactttagttatcggaagacctgtttatattggtgaaaagcctgtcaacattgagcgctacgccagtaacagtaaccaaggtgaagcatatgagatcaaggatcttcatattacctttcagttaaagaaagacaactcaaaggaacctaacaagggatacgtaagtgtatttaacctttccgatgacgttgttaactacctcagtataaaccaaagagaatccctcgctgtccttttaaaagcggggtacaatggtgacgaaaaacttatcttttctggaacaatcgagtttgtagaggatactttctcagaggaaacacgagagactaagtttatttttggtgatggaacactaaacttgactaccgccacaacctcccgatcttaccgaaagggaacgcctgtgaatcaggttcttaatgaccttatctctgatcttaagctacccaaagggcgtgttgttccttttagtgctgacacattacagagttctatggcatttactggtaatgcggcacagaacttagaaaaccttgcaaaaaatactggatctaccttttccatacaggatggtgctgtttattggacaaaagaaggctccaggtttgcaaatgtgatgttcgagatctccgaggaaggcgggatggttggcactccaacgttaaagcaaccaaacatctcgaagaagaaaaagaaaaaagatacaaaagagacttcaaagaagaagaaggagaagaatgtaaaggaggacgttggtttgacagtgaccacactccttaatggtgcgatccttcctgagtctacagtatacctgaacactcgatacattaagggtttttacaaagtcattgagttgacgcataggggcggttacgaaacaggcgactgggtaaccgaattaggtcttgcagaaacacgaggggagttgataagataacttatggcttacgtagatcgttatgatgcagcactatctgtctttgtcggaagatatctgcgaaacaacgtgcatactaacatcagaggaacagtggttggcgttaattacgccattccctctgtcgatgttaaacctatggcacaaacggaatttgataacggaacagtagaagcttatccagttatttacgatgttccgattaacttcccttccggcgcaggtggaaaggcaagattatctatgcctataaaagtcggagatttggtgggtgttgctttctctgaaaggaacgaaggtgactttaaggatgtgaatacccatcaattattccctggttgggctgtgacgcagatatttaccgaaggtaatggaaaggctgctcatcccgacaacgttgttcttgagaacgataaaggtgttatgacactgatgcctgatgggacgatgacgtttcagaatcctgctgccaatctaaagattgagcaaagtggtaagatgacattttcgaatggtcctgccaacatagaggtgatggagtctggaatggtaagggttaatggctgtaccataacaacttccggtaacgtgatcacggcttccggtgtcgatctggaagatttttatgccgactacctcaaccacagacacagtggtgttgaaagaggcggtgatataagcggggttaaagtataatggctacagtatttaaagattttcttttagatcctcttactggggatctggacttctcgacgagaactttacaggtcgttacctctaaccagatgagcttacgtcaaaggctttatcttcgttttggtatctggcaaggaacttggtatttcgatgaaacgataggattcccttatgggatgtttattgctaagaaattatcaaagactgtactggataataggataaagcaagaggttcgtcaagagccggatgtgatcgcgataaaagatttcaattcctctgtagagatttacagccgtagttataaatgcttctttacggttgtaacgtcagagggtgaagagattaacttcgcattcttaggtgatgatacttatgagtatccgacaccgccggaaggtaacgttgaactgtgtggtgacgaaggttctttaattgagttcaagaacaagctttactacctgattaacttcagattaccgaaatatggtgactctacttgggtcaacacctggaaataacctcaagggagcctcgtgctcccttttcttttaattctctggatattatgataaaatacgcttatcgtctaattttggagcaggaggaacaatggcgtccaattacggtctaacgggtagtggatttaacctcccgccgatggaagacttgattcaggaaacgaagaaaactttcaagaatgaatttggtgaagatttcaataccgaaagtaactcagttgctgacaaactcatttctatctttaacgaacgtgaatatcaactctggttgttgatgggttctgtttattacgcacagacaatgcaaggtgcagaaggtatttaccttgacgaccttttatctaagcgtggtatttatcgtaacgggaagactcgaagcacaggtcaggttcagttgaccattgattccactatcccttacaacatgatttactctgcctctgcatacaccatcgacaacgattatcgtctatctaacgatgttcaggttgcaggaaacatttttgctcaggtcatccgtggttcggatctttctgtcggaagttaccgattacagatccagaacatcaatgatcaatcgatcaagaccatgacatatcaattgacagccaccactggtgcgcctgttatagcattcttctctgcaattaaagatttcattgtggagaacactattctgtccaaccgtgataaaatcattattgattccgtagccaactctatccacattgggtatgatagtaacaagaaccttatcggcttgtcaagcagaatcgatttccgtactcaaccattggcaggtactagaactatcacaatggatgttagagctacggagcctggtttaacatctcgtgatgctttcagtgttcgtggaataagtccggttccggcgggtttccttgacttgacgaacctgattgcattcaccccagggtcagacgtagaatcagataatgaataccgtctccgtgcaattgatgcagttaacacaggaaaggccactcgtgcagcgatcctttctgcactgttgaacaaagttgagggtatagaaaaggtaaggatctttgcaaacaataccgacaagactaactctgttggtgtacctccttactccttcatgcctgttgtttacggtggtaacactgctgaaatcagtcaggtactttacgacactatcgctggttccaacaatacgtcagggagtactttctacaacatcaccactgaagatgaccaagtagaaacaatctggcacacgaaggcccaagctcgtaacctgagtatgagaatcagctatcgtggaagacctctttctgttgtcgaagaaacaactatctcaaatagcttgattactgcgataaatgggactattatagccggaactctgtacaacgttcagttggtaggtacagttatcagttcaacggcatcatctcgtttcactcaagtttttgttgagattaagaacgtagaagaacctgagtcttcctatgttggaacagatgtatctgccgatgttactgaagtattcgccctgtccgcagagaatattgaattccgtcagatagtttaaggagaaagaatggcagaggttacagaaaagaaggatgttaaccacatccatcctctgtctgatttcgtcaaagggggtattgattatttaccccctgagatctttgagaataaagataacatccaaaaggtccttgagatcttcttgaaacgtcttgaactcatagatcagaaagctgttgaactggcagagatgagaacaatcatcaatgcagagggcgacactctcgacgaaataggcagacaaaacggtatcttccgtaacggattgaatgatcctgagtacagggctgttattataatccttacagctattggatctaaaagtggaacaagatctgaaattatatccacactgaagcaattattcggtgaggagggtgtgactacctataagggtagaaattaccgtatggatattaacatcttcaatacctgtgtggaagttgagcttattcttgaccaaatacttgatatgctccctctggtgactcacttgcgagttgtggagaatcagggatacccgtttggatttgagggtgacgaacaagcatttgggtgggcatccgtctacgacactgatcgtactggcgcgggtggactcgcaactttagtttatgtatctgacgacgaagacccttggggcttttaatgggagaatttaatggctagaccaacaacaccgattgttgtctttgcggcacaagatgttaaccttcctggtactggaagacctaacaaatcaaaaccgattgatgaccttttagcgaagggctatgacaaaggacaaaaaccagcggcagaggaattcaactatattcttcaccaatctggtgcttggcttaactggatcgtagaagagaagttccctgaagttgaagaagaatataagcgactgattcaggaactcgaaacacgagtaaacaatcaactggaagttattcgtgaagatgttgcaaacgtaagacaatcagttgcaaccttgagaacttatgtagagcaaactgttgcagacattcgtcgtgagatcactgcggttgatcagcgtgttactcgtttgtctcaagacttggataatgctgtttccagattaaacgcccgtattgatgagcttgaacctcgtttagttccgatcggtgcaattcttacttgggcaggccaaacacctccggcgggattcttggaatgtaatggacaggtatacagtacatctcaaaacccgaaactttatcaagtccttggtaggaacgtagtacctgattatcgtggattgttccttcgtggctgggcgcacggatctggcgcttacgatcctgactctggtcgtgctttgggttctattcaaggtgatgcgattcgaaacattactggtgcgatgggttacgaaagtattcgtactgaccacggatatcgtgagagtggtgcactttatacgcaatataactcaaactcaggtcctgatcacgatcgtaaaaacccagcgggtgatgttcgatttgatgcaagccgtgttgttccgactgcaccagaaaacagacctaagaacgtcgcagtgatgtatattatcaagactgatcaggcacaaggtacgggaagtctgtcaccaactgcacttgttactacgccggatagcattacaaaccgtgtaggttttacccgaggtatctcagcacaggttctccctgcaaacttggcgagccaataccctgtgacatggacctctcagaatggtaatgttgcaaccgtagatagtgcaggtaatgtgagattaactggaccaggtgaaactaacatcatcgcctctatctctacaggtatatcagcacaggttaaaatagtttcatacacaccattgacagcgatcagtatcggtagcatccccaatgtggaagttaacgactctgaaataatccctattaatagaacacctgcgaactctaatgaaccgcttgtgtattccaccagtaatgctaacgttgctgtcgttacacaaagtggatatgtatcgggtgttgctccaggtactgctgttattactgttcgtggatctattacgggaatccaagcaacaaggcaggttacagttattccagccgtagttgttcaaactatcgaagatgttcgtttaggtattgagcaacaaacgacaatgaatggggacaactataccagtcctgtacgtgctccggcaggttgcgtaatcactggtgttgtttcagcggggcttggattaaaccaaggttattacaaaccaatccagaagcgtatgtctggcgtatgggtaacggtggagggctaattatgagaatgaataacttcaagctttatacaccggaagttaaagcttttggagagggtgttcagtattttcaggacgataaaggtcgtgatttctacgactctcgtgaactgttcaaaaagaaatatgttgttttctttgatgaacatagcattgtccgtggctgggcaaagagtgaagaggttacccgtcttcacccaggtggtttgtctgttgtggatcttaataccttacctaaggatttctctttacagggaggtgtttggtcattcaatggaaaacaggttgttaaagcagattatgaccctgcttttagcaccgctgcaagaaaggctggcattctgcaagtgatcggttctgttatcgttccgcttcaggatgctgttgaattgggagatgctacagacgatgagcttgagagatataacgatcttcgcaagatgagagttaaagtcatgcgtatccctgatagcacctcccctggtgatatcgactggtcagagttcaccttttaaccttagatgagtcgggcttcggcccgactatggagacttatgattgttgatataatggcagttcttaaagcactttggggtcttttaacatttattttgctgggtgcactaaagatcttttacaccgactttaaaaaattagagtcacgtcaaagtgagcttgaaaaagatgttcttcgtttgaaggaatctgcggttactaaggatagtatcgatgccattcttgaccgtaagataaaacatatcacagacacgatccaggatattaggaccgacatcacagatatgcgaaaggaagcaaaagaagaaaaccacgctctacagaaggacattcgagaattactaaacaaaattattgagaaccgcaaatgattacagccataatatatggcatttgtttcgtaatccttgctactcgaaaagagagtggaacaaagataatggctgggctttgcctagcctatctcgtattggagaacctgatcctttggttcttctctacgcaacaatatttcgacatcactctttattttaatgttctctggacattggattcgatactgcttttcactatgggttgtacagtgaaaggattacgacaaaaacttatcgtatgcctaagtattccgttcatgcttattcaagtgtttgcaatccaatatccagaattgttccccttatgggtttacgaattcgctcttagagacgctcacaaatatttcatagaaacctttgtgttcgtttattcttggaaggataataccgtaccggaatggataagaacagcagtagtgatatttctagtgctcattgcccacatggtatgaacattgataatgaaggtgatctatgttaaaatttctcaaagacctagtgacctctgcggtggaaccagataaagcttctcatacgaagttttggtctaacgtaggtatggctgctatgactgccgtctttctctggtatggattcaacaatacattgcctgaatggtacgtatggctttatgcccctacggtagtggccccacacctgttgagtgacctcatcaacctccgttggggattatctttgaaaaaagataaagacccttccgacgaaaacaagtaagaggagaaaactgtgtcgtctaatactgatatattggcactggtaagcactgaagcagacctcgctgttgatcagatcatcgaagactctcgaagacttcatttgatcgtcaacggaactgcaacagaacaagctgttacagaagatggtagcttaattcctagtgtacgtaaagcgataattgataacttttattttaaaactccaccgttaccgtggagaaatggaagttcagttattgaattcaatcagttgtatgcctttaccgatgtaaatggcaacgtaacttggtggtatgccccaggtgcaaccagcagtacccctgtagttatgcgagatagtccaatcaacgacgggaagtttagacctttcttcgataaaggtaacattcaagaaacttacgcccctatcctttcccctgtcttccgtggaaaccctaccgtaccccttgctgctgaaggcgatagctcatttactatcgcgaacaccgcttgggttagccgagaaatagaaaaagtacgtggtgaggttcttgaagaatccagaggtgaattccaaaacattatcgttgcagatgatgcgagtttgaaagatctctatgtaagtggagaaaccatctttactggtgataggatcgctgctcttgatgccgagttatctttaaaaagattacgaatgacaggcacaggcgcagaaatcgcatttgaacaaaatggtgttccaccccaggcaggattaaccaaaagaacaaatatcaagcctttccaagtcaccacgggggttgttgatacagataatataactgcgagagagatcaaggttggaaatacctctgtttccacgaattccctcgatgttgatggattcatgcaaggtgactatcttcacttacagggtaatgccaacaacgcagaagaccgcccacaactgatcgttgacggtgttgcggaaataaatactcttcgtgtgacgaacaccattgaaggattgaaggctgacgttgaaggtctggatattaatcctaacagtattgtggttgaaagaactgcggagatcaagggaaatacaacccttggtgcagatctttccgttgctggcaataccgtattgaaaaatgtaagaatcgaaggtactcttactggtgcaggtatcggtgttgacggtaaagatattgcccctcgtaatgtgagtgcaacatctgttactgtggcagagagcttaaacattaccggacctactactgcttccggtgacgttacagtaaacaacctgacggttaatgggacactcagagccgatatcgattttggaacctccgctgttgaatttcaagacctgactgtaaccaacagggcaacgatcaaggatcttgagatcaccggaaacctgacgggagttacagtctctgttgatggcgaagctatctctccttcctcggtgaccaccaccggaaacatcgatgttggtaacaacatgcgtgttcgtggtgatattactctggacggtgagttaagcatcccaagcttagatactggggacataacggctgcggcaattgatggtgcaagtctctcagttagtggtgacattaacgcaggaacaaattcgaccacaacggttaataatcttgtagtcacaggaaccactacaggaatcactgtaacgggcaatgttgatggacaagacattctcccatcgtcggtagaaacaacgtctgtagaagcttctgagagcgttacaacggcaaacctgacagccactggagaaactcaggtaaataacctgacaatcacgggaactgtaacaggttttgaagtagacctcactggaagggacattcaggttaataccctgacggttactcgtggatcaacttttgacgaggttactgctaataacataaccaacaatcaaaagattactacggtagatcttcaggtaactggaaacctgacaaatgccaatggtgagcaattctttgcaaacgtcactggtcaagacattcttccaaatagtgtgcagtctgcaacgtctgtgagaactaaaacgctacgtgtcgaagagactagcctcttggaaggtgctgttaccttaaatgatggtttgactatcaccgctggtaatatcacatctgttcaaggtcaagcaagtttcaatgacgtacaggtatttggatctcttctggacgcaaatggtaatgccttagggacagcggaaagcataaacggtaaagatatctctccccgtagcgtaaccgctcaagttgagattcagactactgcaattgttgctacaggtcaagctgaagttggttctttgatttcaactggacaagtaatggcaggaagcttagaggtttcagggataggcaacattgatcaagtcatcactgatgatatccgtgctggtaaagtaacttcaggtaacacggttatcactcgtactgtcgggtctagtgatcctgctcttgaagttcgtggaccaggtgagattcagggcgaccttaacgtaacaggaactgtaactggcaacattgaccttagctctcaagacgttaacactgcttccctgacctcaactggaacagtaaatgccctttccattgagtctcgtacatcggtaactggattatctggtacattcggtgaagattatgaaggtgcacctacatacgggataacttctctttccggcgcaaacatcaacaagaaccttcgagttggtggaaacctgactgttgttggtaacatctctggcaatatcgacttgtctggaaaggcgatcgagcctgcatctttgtctaccacgacagctacgttaacgacggcgaacataacagacctgactgtaactggtcagtttaatatcccgactgtaccgttaaatgttcaatcccttagttctgaaaacgctatttccgcaagcaagttcagcaccacaccaaaagaagtaagcaccacctcttcttcttatatcccagacggctcaacgagcatatataacgtaaacgttataaatgatgttgaagtgaaagcaccgattggcctgttgagttcaggaaaaggtgagtcagtgttcctcttctttgaacaggatggtacaggtggacatgcggtaacattcggatcggagtttgttgtacacggtactgaaaccatcaacacagatgcaaacactgtatcggtagttaacatggtttatcgtggcaaaggcccattgattgacgtattcatcactcgtcgctaatagaggcccttcggggccttttctttttaggaggataaatgatcccttttccaattattaacttcggcggcggtgttccgctgcctgtaggcgttacaatcaaatatgccgtaagcaccagtacaggaaatatttttattttgcttactaatgggcatctgtatgtaaccggatctaattatttaaacgggcttggtaaaacagggaccacaaataatgcaacttctggatggacactcactaacacgggtgtcgaagaagtttatgaggcaggcacagacagtacactgtacggcggtgtatgggttaagaaaaataataaccactatgaatatatctctgccgtaatcttccccactgttgacacaactctccaaaacagttggaacgtcttgcctgaatctgcatacattgttgacggcgtaaatatcttatcttccgcaatacaaatagctagatcatatgcgatccaacctgacggcactgtttatagacttcttccagacggaccccaaatagcttggggtgaaaaaacaaaatatctgtattttgcaaactataatgctattcgtgtcgaggttgatgggactttaaaataccgaggcgacaatggtatagatcaagtagcaggtacttctgccggaacaacattatcaacttggacaactattggggacccttctgtaagatatattagggcaaaatgtgctcgtggtcaagtggctaacacggctggcggttcaggtgctcaatctattgtacttattgttgcacagagggaagatgggtcatgggatgcagttggatcggcagcaagagcagggataaactcaaccaacgtcctcggtcctaatttagcacctatggcaagcattcctgctggagttgaagtttacctaactaaccagatcagttatacaaacgcaagtgtgagcactagggcagcactgcaagtattcatctctgacagggttaatggagtttatcaatcgacaggtggacaaggtggatacacatactccttatttagagatcttcctataaccaccaacgcaacatctttcgagaacatatctgaagatattataaacgatggcggtatcctcaacatgacaggttcattatccgacactttcaaagtgattgttagtggtaatggtaatctttactggacagggagaggttacacaggggctatgtaccctgctgactttacggcctctaatacgatagctcagaagtttaacttggaaggtatagttattccagcataaagaaaaggcgctcaaatgagcgcctttatttttatctaaattttacgatcaaaacggaatatcgtcgtcaaaatccatatcatctacagacatatttacatgtccttcaatatcaggggtaggtgaatcttctgctgacggagttaactgcggttccggctcaggtttcttttcctcttgcttaggagttgaggctccgttacggatcttatcttccaattgacagatgaatcggaaattctcttctgtcttggcaataaaggtttcgatattgtcacgaccccaacgagcagagagaataccgcactggcctaaacgcataccaaaagagtaatcatccatatatttaaactcttcacgtagttttgctctgatcgaatccatcgctgcaagaacttgttctataacaataccctgatttgcgatcgtttcattcgggaacattgcatctgtgatagacagtgcattacctaaacgaatagggagatcatccttacctttacctgaacgagaacctgttccggtgtttgcaccttttggaccatatgctttaaagccagttacagtaccatcttctgcacgaacacctgcaatacgaccaccttctgaaatctgcgctgactgctcatcagtgagatttacagtgacttctgctccatcttcaagcttaacaactaccttattgccttcgatagatgtgatatcaccataaatcttcttagctgcaccaccagacggcttttgctgctgttgggaaccacttgattgctgctgttgctgacgaggctcacgagcaccagatgcgtcagtaatcttgatacgtgctttcttaccctctgtagtagaaccctgactaccatcttgttttgtgtaggtcttgataacaacaggtaaacgaattttcataccctctttaagatccgtgtaaccaccttcaggatttttaatctggaactgattctcatacttcaggtttttaacttcaccctcaccaaaagaaatccatgcttgatcttcaccttctttcagaagaactgcatagcggtgggtattgttaatgcttttctgctgaccagtattcttgtctttgaaggtagtcactcgtgggctaccatctttattaatacgtttgatcatgatacgttcaatcgtacctgctgcaatgtttactgtggtatcggaaacagcatcgtatacagcattgataactttaacttcagacatttaaatctcctttaactattgaacacaccacttaaggccgagaaactatattacaactaacttatttgaattgcaaacaacttttagagataaactcgcttaactttttcatgaacattatcaaacaaagtgttgatcatctgcaagtctttaataagttcttccgtaaattgttcttctctgtgagcaaacacacgagaacggtcaatgtttacgggatctgcactttggtcaccagacaggtcgaaaatgtcgataccaatacgagcacgacctttttcaatcttattctcatcatcaataccataaacactcatgatttgcatttcacgatcttcttctttgtttgtatagatgatcgtggtattcagattcttaatgccatcataaatgtggatattacgtgtagctgagataggtatccaatcaccaactagataatctttaccgtcgaaaatactcatcttctttcctctgttgtttaagtggggccattatgccccaagtagtactttctgtcaaggacgttttggtggactaacgacaccttttttagataaaggtaattcgtctgcatcttttccacgaagagattctagccactcatctaaagacaggggtactttaccatcacctttggaccatacagacaagcaatacagatcgtatgcagatggacctcgatcacctttgtcaccattcgacccttttaaactatccagccaatccttctcatttagtgggatagcgctaggatcttctttacgaagaattcttaggtatgtttcataagcagattccccacggggaccaattggaccaggtaaaccttgcggtccctttgcatactcaagatacttagaatctaaatatgcagactttgaaccatcattgaccactgaaactttatacaatgaccaagccaacagaactatccaacaagcaaacaatgcaagcgggtaagggatcattgaagtaaagaatgacagggctaaaattacaaccttgttcttgtgatcacgacggaaagcgatgatcacaggggctaaccagatagcgaagataacccatgcagataagataaacaaccaactaatgtattccattaagcctcctcagtatcgtctttaaagtaatctaacatccaactctctacaggtttcgcatagtaacctgttcgccctttcttttggaactccataacaatttcatttgcaataccttttgtgattgcgatcccgatcagtgcaccaccaggccccattactgcatgtgaactaagatcattactcattattaatctcctttctttttaggtattctaacatatattcttcagcccgtgtaaccttgtaacctgatttcccctgcaatttaaaaacatctacaatctggtctgttattgtttttgtaatgactatacaaacaacaacattaccaggtccaataactgcatgagctacgagattactattcgtcattactttaccttcatttcactttttaaagattgagcatcccacgtataacctgaggagatacctttttcacgttcattatccttgaacttacaaactacagtctttgcttcaccatcaacaacaaccacataactgttgtaataattgtgttgtgccttgcaaaattcgtgtaactccttaacctctgttggcatcagagaaggtagatttttgtatcgctttgtctgctcatcttcaccctctccgcaaccaacaagaagaagtatacataaaatgattaaccttttcaatagctacctccaaaatattttgtagtctctactgcaaatattgtcccaagtatgaaccatgtcgcacttagtacattgaaaggtaaaaacctcgatcctgcaagagaaaccataataaaaaacgttacaaaaatttctggagaaatcatcattgtttgatagtccccttcgcaatcaattcgtcaacctcatcttctgcgcgacacataatctggtaaatagtttctggattgtttaagaattctgtatacttcttgatacggcatactaaacgtgaacgaacttgacgctcccgagcaacatgacgaaaataatgacctttctgtcgataaacccaagcatagtatacagtttttgctctatttcgatcacaacctaaacgttcagctaattctgtgtaagggtcattgttggtcggaccaaacaaaaatatttctgcaaaactttccttcatgatacgagattcttcatccgtgattcgcggacattcttcagaaccgtagcgtggggttttagtggcatttggcttcttagggtatactttacgcatttcatcactcctctaattaaaactcttactcccgatgtgaggagcctttcggcccctctcttaaatatcaatcacaactgcttgaagaactactgctactactgtcagaagaataactatcgtatgaggatgagctatcatacgaacttgaccgacttgaagaacagtaagaacttgaactacttgtacgatcttcactggaggacattacggcagcatacgttgccacaccacctaaagctgctacctgaggatcaacctggctagttccatatccatttggagagtcgctcatcttacgtggtgctgcccgacgtgcctgatcaatatactgtcgctttgccttcggcggtaatttcttaccttgagcataggacggtaattcaacgcccttcagttgttcattcaaaggtttcggcggtgtagcctgtgattttggtcgttcaacagagatatcaacaaccttcatcgtcttatctttgatgtttaccccaaccaatacttcattttcttttagtggttcttccagatcgcgtgtttccaccggaccgaatttaacgcttgcagtttcctgacgttgttcagcctgctttgcaatatacttatcgatcgccgcagtttctacttccagaggaataaacagagattttacccaagcaacaaacttcttgatcatactctttctcctttttcatcaataacaattagtggttcaataactaaaagacgttgcttcataagactttttatagtctcgtcaatgtcagacagaagaatatctttttgaccttctatccaattgagtgctgccttttctgaaacaaatgcaataccttcttgaccaatatcccattcacagaatactttatacaccatcatcctctcccttgtcaacattattcggattcagtttcttttctgcggccttcaaaataatatccagcttttcaatttccttatgtaaaggctcagataataacttctcaccaaaaagccagaatttcttcatgcctttcttaacgcactttcccataaagcccgcgaggtcttctagtcgccaagcaataaaactaaatattgcagctaaaaggtgaatcaaggccagcagtaaacgatgcgggtttagtacagcaaggcacaggatcataaagattattttagtaaatccccaaataattttcattcgtaattaatctccactttaacaatttcaccagttttatcattgaatacttcaatgtcatagtattcaacaatgccttcatcatcaaaagaacttttttgtttacaaggtgatacccaaaatccgtggattactgcctcctccagtccgtcgatatgtgatacaacactcaatgttggataagggaccataataggttttacctcaccacaaccgcatgtacagcagaatacctcatcctcttcaagttggtacaaccgcttttctggaacaaaagtcagatgcgccaaaggatatttagaaacgatggcattaatataaggctttcctgccaagctgtcaataaattcattaaactcttttcgattttttgataagctcatcgagtacctccaaaaatatttaaagctttagaataatcaatgtgacctggaacagtgtgagcctcttgtacaagacattcccgacaaatacgtgacacaactgttgtcttgatctcttctgtatcgcagaagcgagacaatacttttgtaacttgattgcactgagtaataacaaaatcatgtttacaactcggtttgttttcttcagtttctttctttttaaaaggccacatggtgactcctattcttcaactatttcgtattcatctttcaagagcataaattgatagcccttgcccttattcgcaataatagtaccagacgcgctttcttttgtcacgaaaagaattgaatctttttggacaccgtaatacttaagttgctcaagcagtttggtcttcgattctaagattttgactttcattagatatcaattactacgatttcaagcattgaattttcaacagcttccttaagctcatcgtatacaataatagaccaatcattattaagattacctttgatcagtttagccacctgttctaacgaagtcacaaaaggtgtgtcacattcattattggagagacttaactttgtatacataaagccatcatcgtccgcagtctgccaaaatgaaacaaattcaccactgactttatgttttgctgagtaaaatttcatttaattgacctctttctttccgagatactctttaaggatttcgaaaagttcttcagcttggattttgtccataataacagaatcttcggcatggtagatttcgatagtgtcgtcaaagattgcaacttgttttttgtcaaacttttcagtttcttttaagaattttttcatttatttattccccttagtagtctataacttttctttacctaaagtaagattgatctcgaaagcttttgttgtagctttgtcgtccttgtcgaagaaattaaattggacatagctctcagtcgaactaatagccatacctacagagacagttccttctggtacgagatgcttatattcttcttttaacacaacgtcgtaaaaatacatcgtcccacaatcaatttcatcccacccatcaaaagattcgatgaaagctttttcaataccaactaaagtcttttctgacattatattttcctcttcgtttcaagttagatatagtctacaccagcttgttccaacaagtcaagccttaatttaagttctttttcacgatagtcggaaacaagtttatcctttttcttttcttcttcttcgaactggtcgagtggaagaatacgaataatgtgttctgccttcatgtaggatgttgatccgataagctgaacattaccatttggcagtagtcggcctttgatcacccgataacgaggaaacagatcatatttaacaatagctgtaactgccagattactcatgtgcattctccatatcagaaattcgatcttctacccaaccacgacggtaaatgttgaggtaagatttaccttttgaaccatgatgggcatattcgtcaaaatcaaaatcgaaaggtgtctcggtgttaagacctgcatcaaagaattgattcttcatttcgaattgcactttcatgtctggatcatttttacccaggaatgaggacaaattaaaacaaaggccagcgcctcggtaaaaagccccatcttttggtgcaccgatatctaaccattttttatattcttggtagaaattcagaagttgcggactgcttttcattttgttctcctcatttgttttgataggactactataacatagtcctatcagcttgtacactatttaattgaaggttttatgaatgtttggtaggacccttctttaatgtgaactgcaccatacctctctgaataataaaaatcatcttatattccaaatgtggatttgatcagatcgatagtctcttgtgcgtttcgctcagacacagatacctgaataattttaaggtcgctgacctcttcaaagtatttgaactcagattcacgaagttcaaagtacattgctccgcaggctgtctcgaatgaatcacaccctaccgcaccatcttctgttgtgatgttattaacatactcatcaccttcgatcatactcatgttgttaacaataaatcgcggcccgtgctcatccagaaaagaaacaatctcgtgattgtaacttgggtcagcctgaataaatttttctacgagttttggattaagcttataagttttaccgacttgcatttttgtcctccttatactaggttaaaggtagctttaatcagatctacggtttcttgtgcattaccgcgagaaacagcaacctgaataataacaggttcttcatcttctccgacttctttgaagaaaggaaattcatcttctgcaagttcaaagtatacacctttgttaccttcgcagccgtgaagacagtcactacctaaagtaccatcttcaaatatgatattgttaacatatgtgacattatcatagacgtgggtggtgttgacaacaaatttaggaccgtgtttataaagaagatcagccaattcttgattgtagctagggtccatactaataaaagctttttctaagtcttgattaagcatgtaagtttttccgatttccatctttgttctcctcttcagttgatggatacatcttagttgatgtgggtgtgtcttgtcaatagctttttgcacataaaagaaaaccaccccgaagggtggtttaaattatcagtggcacgccccccagttcatccctgtgaggtattcacctgttatgtgtacaggagatttcatcattcgtgccgcttgctctacgcaacgaacaaccatctctccaactggacaatacatgatcgtgtagattccattctcatcaggatcacacttaaacttcccttctttcacacaatgaccatctaagatcattttcttagccaagcaagcttctacaaatttcttcgcgtcagcttcgttgtcaaaggtccaagtcttcttgaacttgtgcggcacttcaagctggtattcatccaaaagtttaacgaggtcgttactctcgcccacatcattacatgttgccatacgttttcacgtatggatcggactatatcaccatccttttcaggatgctccccatttcgacggcacttgctcgcctacgcctctcggctagtctctgaacgttaagactacgtatattcctcgcagtcctcttcgctgctgattaacatagctgaatacatcagccttagtcttccagcaattaaaggagttattcgatgtagatctctctacaaagccacaatgttacttatggtaatagataatacgtctaacgccttcatcataccaacctttcttaaccaactgccagtgcaggaggatacccaccaagtcaaacagtgcagcaccaccattctgctgataagcgttaagtaatgagtgtttggaacgagtgtagatcttacgtccatccaagccatagatgaatcgcttaccgttcgcttcccaaaacttctctaatgcttctttacgacctttcaagccgatgttgctatcccagaatgcgtcgattactgcctgggctttctcaagggtgattcccagcattgatgcaatcttcgctgcctgcgccccgtacatgattccgtatgtcacccctttaccttcgccacgagaaaccttcttccctgctgctttggtatacgcttctgcgtttcgggagtgggcatctccagattccatgatacgaagataagcaccgccatcgaaatcataagcgccccatgctgcgatcataccttccaagtttgaaccgtcgatacctacctgatatttaccctcagaggctctgaatagttcacgcatctctttaccgagaagaactttctcatccggcttaggtacgtttgctacgatcgtatgcttacgacgacctgtgttagttattccactataacgggccggaagtttaccgtcaactcgtagacgtggatggttaagccatccggtatcaaccttctcttcttttagcgggtcaagaacagatcgtcggttacgtaaagacagccatttaacaatctgtttagccatttcaccatctactcgctcaaggttagggcaaagaccctgctgatccttaagttgtggagatgtaggtaatgcacgagctttcttacggaaaaacttgaacatcttttctttatctgaccactgcttaggtgtgatcgccaagcttttcagaatcagatcacgatactccgtctgatccaaatcttcaatgtattgacgaacaattagatcaacttcactatcaggacgttgtttcttgaactgatctttagttgcatcctttgtacgccaaattgttgggacccaccctgcatcacggatcaggaacttcttaacgtcgtcctggttaccaatacgcatcggaatcataatgtccggcatcttttgttctttgatatccatcaaagcacgagccatatcttccggcggcaaaggaacaagcccttgctgcttaacgttttgtgcacggataaaatcacccattttggattcgtcctctacaccgtgttcaacacaatacttgatcgcggcggcagtaagagatccgtcagccttaaacggcttacttggtgcgcctttaaattccaaggcttcccaattgatattataacctaacttctctaaccatttccaacctgtaccggaaagagatccatcccccttaaaaggtttagatgggaatgtcggttgtgctgatttcgacatctctttcttcggcaacttaggttcaacctctaactcaatgtcggtcatcatcttatcgatacgatcacgaagcttcagtgctttttcttcatcaaatgaaacaccctgaatttcttgctcaatcatcaggtagtcagtcaacatacctcgacgcaaggcattcttccagttgatcattttaaacttcttctgatctttgtctgtttcatccttaaacatgaagcgtttatcatccggcatagattcacaagagatctctttcatcagagcatcccacaccatttcgttgataattacgtcttcaataatacgatcgcaatatttccaaagtggaaggccacgccaatcttcaatcgccactttctggttggctactcgcataccccaagcttcaagcccgtgaggtcctacaggcttcattttgcctgtgactgggttctttaccatctcgggacaaccacgaggcagagggcgatctggatacaatgtacgagacattgacagtgtatcaaagatggtcacttgtttaccattaatcgtacccatgcaaccagggtctgcaaacatatcgtaagttgttccaagcatcttcttaaacaactggaggtcgtagccgaagatgttgtggatagcaattgccttaggctctgtgacaaaccattcgtttaattcttcaatagtgcgaatcttaaagtttttacctttagattggataaatttaacagcttgatcgtaaccttcccgttggggatcaagaaagatgttccagttatcttttttatactctttaaacaggacgcagtgaataagatcaacctctgtcaacaggccgttagcttccgcatctccaataaataagcctttcatttttttctccttctttaaactccaactagactaaaacaaagcccagccggaggtattacccttcggctaggttatcaaaagtgcaggtatccttcatcaataaagtaaagcataactaaaatagcgaataccccacctaagaagattaaacccagtgaagtaggcatcagtcttctattacctcaaattcatcattaaaagctacgatagtttcaccgtagcccatgttcaatcgggcagttgtaggtttgccattcctagatagatagtacaccctcgcttcgtaaatgtcaccaacttttacaccgtaagcctgtaggtctttgttattgatatctttattttcagtattgattattcgaacactgctaatctctgagtatacagaattatctttcataggtattaccaatcctcttctgtttgttcatactcggaaggggtgatgaagtaattctgcccccgcttacactgattgaaagtcccaacataccaagtaccgatatccatgttgatgaaagtttcttcgtgaacaaggatcagatcagcaagattattgtctgaccgttgggtaactaacaaaatatgctcaaaatctgctaatgtcatgttgtaacagaaaccatcttcgtcctccataactgcaacaacagagctacgcccttgggtgaattgacgaaactgtaaacgtaaatgacgatgttcatgttcattcgtcttcacctttttccgattttcgaaatattcttcggaataatttggatgccttaatttcagcttttcgatctcttcggtagaaagagcatccttatcccaaccagtaaaccatttaccgttatcattaaataccgcagggtatttacgcttactcaaatctttaaacatttgaatcatctccttcagctaggctacgaatatacttgaaaatttcttcatgatcattaccaaatgcaacatatcccttttcagcatcaagtccataattatgctctattttctctaaaaagcaatttccgtaagtaattttttcaaccaggggatcggattctgaaaaacccaacccaaaagctttccagtgctcacgtttaagctccacgtattcccacggtttatctccatcgtggaataacacaagggtgtcttgatctttcttttctacattgacatgaccataaaatccactgggcgatttgttaaatttcataatcttctccgtaaatatctttaatttttgaactgaggtatccaggatcgctaccatcataccacacttctacgaaaaccttttgggaatccttcacgatctttgcccctgctctttcaacctccttgaagaaagattgcaagatgtgatcatctaacaggtttaccccataagcatcgtggagggatttttcatcgtgaacatacacaaccatcttaccatcatacgtaacttgaatgtaatggtcatcttcccaagtaatagccggagaatccggctcaagctttgcaataacaccaatagtcaatcggttgtcactcactctttaccccctgcgatgcgtaacatttggatagttttctccagttctttacgaggtttggcaactaaacgacgttcgtgtcgcttcaggaagccttctaagaactctaacggtttaaaggataacacttcctgtactgattcgtcaacagcatactctttctggaccatacgataaaccggattttttacagttacaggagtataacccttactgatcgccatttgggtaacaacacgcttcttgccatcggtccatgagtcatcgatcgggaaagaatctttgccgtatttttcagagaataacttaactgctgtttttgtcaagtcatcctgatcttcttgtgaccgactttgaccccaataatagccaccagaggtcttagcacgacgctctgagaacaaagcaaggtcatcgtactgctcaagagccaaacgcgccagaagctcgatatcgtcgctttctgacagtagtcggtttgcttcgtacttaacctcaaaagtatttgcactatcacgatcacggtcgagagtaaaagcttccggcttaaagtcataatcgaatttaaaatttcctgggacacgagtaacgaacagtccatttacaaacaggttgcagtcaccacccgtgatagacccatcctcttcttcattttggtattcgtccgcagcattgtacagcttagtataagctttgcctcgatcattctgaataacgactgtacgttcagttgttggtgcatagttatccataatttctgacatagcgtactgagggatgttttcaatgatcacagttacagtatttgaatcacggcccgacaaagcattttcatggatatctacagccaaaatgttctgttcataagtggtgtcataaaccatatttggaatccaaagatcattaccattttcgataacgatatctgcaccttcacgaacaagcactaaaagacctactttcagaccttcgccaaacttaccgatcttactgtcatcatcacgtttggttgaaacacccatcaaaaggccggagacaggaacaacgccaccacgagagatgattgtgatcttaccttgattactgtcatcattgccaaaataaatattgaaatcttccgtatcgatagcgttttgcatgagttcacgagcaccttgccaccatgaccagtggctgacgtaattttcagtgatgctcaatttaatctgtttcatttatttaccctcttatttgttgtattgataaattgcttcagctaaaccccgtggagttagtgaccggatcatcttagttcttgctgacttacctcctaacttattctgctgatctgaccaaccaggtgcaacaggaaccggagaggtttttggaattataaacccatttcctgtccaaagtccagtctttttcggataagcatcccgtggtttaatgtattgaggaaaataaggattaacatcatttaccggaaggtaaccaccatattcccaagggttaaaatatacagtaggttttcgccattgtccagctaaaacacttactgggttttcaatcatatacggacaatcgaaaacaaattcagcaagccaggctgcaatcttcgcagttcttaccgccttgatctggaagaaaggatcttttgctttcttcgatgcaaagtgacgagaaccactaacagccatatcggtacatggaggataggcaaggatcaggtccggtgatggcaatcctaagttctctacattctccatccattcaatatcgataaaagcgttaacgtaagtgatgttgggatgaatttcctttacaccttcataatccccgtgatcagcatcgtcatagttgaagcagtagcatttgtgccctgccttcgcccagggaagaacatcaatccctgaaccagaaaagagactccagataatctttttattcatcgtagcatccaaatagtggttaatttacaaatacaccagaaaagtccgatcagtgtagctaaagtaataacacaagtcaatgctataggtaagaatatcgtcataatcactgcaaagactgaaatacctatgcttgcaataagatccggcacgaaatagtgaaatggatctcttgcctttttaatgttgtcccatgttattactacggagctaaggacgagccagaataaaaagtacaaaatgcaaggaaataaagtcatgtgtgacttaaccatatcaaaccacatgttgtagaattcaatcattcagttttcctcggtacagatgcaataacagccttttcgaccagacacacaataaacttcccaatccctgccaaaaggagagcaaagactgtaaaaggaaacccataaataagaaccataaccatcagcccaaaagcactagcaaacaggaattctgtgcctagccacatctttgagtaattgatataattatgccgcaattttaaaaacaatccagcaatagaacctacagaaaatataccaatcaaccaaggtgcggttacaaattgacggctaaacgcctcccaaaaaacaaaaacattaatgattgcttcgatcataaaccatacctcgcttcatataagaattcatcaagatctttactgtcgtctgaaccttctactgtcagtggcatcagatgttctttaagataatagcaaagattgccggaacttgtttctactaaacatgttgttttgcaaaccattttaacccttgccgatagtccggcatcttcatggctgtggaccattgcaaggcaaccatcgtaaagcttatcctcataaggtaagcaaggatctggatttttcattgggaaccttcctcctctgcatatgcaatcttagtcatgtagtcaatacaatcatattgaacattgtggctattaaaaacagccttgcctttgtaaataacttcccaataattaatactttcaatttcggaaaggtaggcaacacacccccccttcggattaataagttcaacctgctcagtttctcgtaatttccaaccagtaggtaactgaacagcttgttccttaaaaatcacaatgtcgtcacggtgaccagttgcccttttaaatgcccgcagtaattctttgtattcacgatacttcacatagaggccatcttcagatttttccatgcgagcttcattgatattgcaattaccatccatatctccaaccaagtcataacgatatacaggtttcattttttaactttctcctttttctcaggttttacatcgcaaactttttgttgataactgatcggtgttacatagcgccacgtctttttaaggttctcaacgaggattctcatttgttcctcatcagcaccccagcctgcggtatgtgctatttcatcaacactcatttggcatttaacataccatcttgtaactgtctttgattgtatcattagtgtttccttgaggtcaagaaattttattcaataccaagttcttttgcactgtaaatatcgttaccttcataacctttgtagtagatcagaatatctttgacaatctctcctgttggtccgctccggcgggtacgtggtcgtggtgagtttaccaaataaacttcaccacgagtatttatttttgttgtacggtgaccttcgacgaaggtcaatgttgtatatgcaggaaccttgacaagaacctctacctgatcgccagcagtattctgttgttcatttgccatatcgtctttaacaacagtcgtcataagtttggtcatttttattctcctttgttcaatgtggatacgaattcgatataagattctgcatttcgtttatgataaatctgagggtagctgtcggttactttgccgtatttgatgtatcgctcaagcataccgacaacaccaccaatggaatgcacaacaacgccttcttcaccgacaaaggtaaccacttctacgaatggactgttatcataagaacgatttacaatcagatcgccgacttcaaattcgattttatcattttgtgagtagtgcatttgtttctcctttctgtttggtatgggagaagtataggggagtttaggaaaggtgtcaatagaaaaaccgcccgaaggcggtttattttagaatcagaacggcgcatcgtcgtcccaatcatccggttctgtgtccggcacatcaggaatgtcacctacggattcaacgatactctgttgttcccacgtaggttcctctgaaggttggcccatttcttccataaccttcttgatctcttcctcttgatcacgcaggaagttatcatccggctcagggatatcttcctctttgatatctgaacgagtgagatcactgttttgttcagacaaaggttgaatctctgcggccttaggtttgaaatctggagaacgatgatcatcttctggatgagcggcataccactcacgaagagtttcataaggactctctaggaagccctctggcggttccagataatcacctgtatcaatgtcatagaacacagggaatttaccagcacgaccgtgtttacggtcatccagaataacaaagtaagaagtgttacgttgtttcatcgggagttctggatctttgttacgttcaataccccacatataataagtgtttcgcatcattgcacggctaccagcaaactgcgctgactggacttgaccaccaaattcatgaggcttaccagattcaggcttgttaaggtgacagaagcaataataagtaaagccaagctcttttgccagtttggagatctcatccgagaatcgttccagttcctggttagcttcagaagcactcataccttgcacaagacgagtgatcgggtcaataaagatatcttcacaaccttctacgatcactgcgtgacggatagcacctttcagttcatcccatactgcacgaccatagttgttataatagataacactatcaccaacttcatcggtagctttgatcagttcttcttgcttaaagtagccacgttgaccttcaaatacttcattaccccaaatgtcacggaaagttccatcttcttgaggaatcattaccttttctgcgttaacaaagtctttatgataacgcttacctgcgatcttcttacaagtgatctcgttctcttcttcaaacttaaacaccgcagcttttgacttctcaatacccgtgatgtgttcaaccatttggttaagtaattcactcttgcccattttcaccgttatgttcgacagggttcgctactccctgcccgttctcttacgaactgctacatgtccccatgcagaccagactatatcttcaacctgtttccaggtgctatgcacttcggaccgcttggtcctactctactcgattcaagagtctagctcttgtctttcgatagtcgttgctccttcctctcaaccgctttgtaatttgtcttacggtatctctgtgtatcccaaaatgctctgcaatttctttttgttgaagcgtggtattaataaccatttcgtaaacctgcttctcaaaatcatcagcatatctatttggatttcttctaccgttggtccaaccatgatcgacattttctttcgtggttgtccattccaaattaacatcgttgttgttttgcctgtcgctatctttatgattaacaacaggaaggttatgagggttatcaacgtagtgttcagccaccaattggtgaataaatctacgtgtaaccttaccatctttacttaacgaaactctaagataccctgaactattagtatccggtttgagttttttaagcttccggtaaacatctccccttcgggtaatgatgtaattttcaaaaccttttattcttttcatttctccctccttgcaataaacaaagaggttgagaggcttggatcaggattacgtgttctacgcttcccctgagttcacatagtatttagtcgaggtatctctaccaaggctggctagacttaatgtttaccagcaccgatgaagtaaccttcacctggacgacgacccaaggtaagcttggtcatggtgggccaagggaacttcttgccgagtttagggatctcatgtgccttttcgcggaactgtgaataagtcgagaaaccatcaggcacatattcttttggcttcattgcagcccaaaacaactgatcagaaagacctttgttatacatatcgcaagggtccatatcttctggaatatccacgaccttcatttgtggaattacagagtataccgctgcaactgcatctttacctttcatgatccctttggccttctctgcttctgtcgcacggtcagcatcgaaagctacgataatctcttcaaacttacttagaagcttatagttattcttctgtgataagttttgcacggcattggatgtaccgttagagatagatacaactgtgaagtttggtttacgagtggaaccatccttcggtttgtacttctctgtcaatacctgccacaagattgcagcatcatattcaccttcagtgataaagatcatacgtttggaagacttatttgcaccttccagcccaaacatatcacaagccacagattggaaaccaatagttgtaaagtgacctttctgttgcttagggattgtaagatcacgctttttaaaacctacaactttaccttccaatgtgtacggaaaataatgtgcttctggagtcataccgtctttagctgacaacttggtacgaataccaaatcgtttagctgtcttttcgtcgataccacgctcagggatacttttacacggataagtcaatacgtcttcaactgtttcttccacacgagacacaccaccaccataattacgtgctactgaagccttaggatttttatgtccgaacttataaccgccaaacaaactttcgccaatagtgctcattactgctccttgatcatcgtcgccaaataaatagtgttaccgtttgaattaatacctgttgttacagaacccatcaatttataaccgtaatcgtaatattctacaatacgtctttcaagagatagtgtatttgtataagtcaggatcttaacgtccatcaaaaacctccagtttcttcattaaatgcctgacttacttgtgcatcacggacacgttcttcaatacaacgatacaccacttcataagggatatcaagagcaatttcttcaccatcttcataaacagtgattgaaaaaatatctaagtaatcttcggcatcccaatctgattctgcatctggaatacccttgtacataataacctcggcctcaactaccacctctttaccgatcgctttatgaaaatgtgtgaattcgaagtttactgtacgcattttattttctcctgataatttatatttatttactgattactttttggaaatgatatgttcttcacgaacttgaagcttagtgccatctttcatctcgacaaggtaggcattgcaaagaatgtattcttgcagcatcaagatcttaccatcacctttcttaccatacttttcgccaacctgatcgaagcttacatcatcatttattgcgtatttgaacacattattcatgcgtattcaacctcactgatcatttcaaaaccatcattttggatcagtgttttaacaaagccgatattaccttcttctatgtttctgtgcaaccacatatagccttcagcacaataaacattgactccatagccaagtttagctgctcgttcaaaatcaccgttttctttcttaactaaacaacgaaccatctttttcatcagtctttcccccttgtggtcaggaacaacgtgtttattgattactttaacaatacgttcccgtaattgttgtgtatgcccatattttgaaaaagtctccatgatctcaccaatatgcttactgaataggtgaggtgggatttttaactttccgagttgatccatatcattcctcaataatctcaagtttaccgttgatagtgtacaacgtagttgctttatcttcaatggcttttaaagcctgaatgacagaatcataaaactgttcagattccttaacttcttgtttgcacttctggatatgatcagcactaatgtcgcgaagactcagcagttgtgcacggttcagtacagataggtctacagaaaaatcatcaactttaaaactcatctctaatctccttgtttgtgttcagttactttatcattttaagataaagatgcaacaagtttattgcatctttttgaattatttattgatccttgaagatactggggaacttctcgtgatagaagtttacaacatcttggtcaacaatgatatcttttactcgtaagcgtttcaaaaggcgaagaccttctacactcgtggcacgggagagcataacatatgcttgaccaggtgtgaaagtaccaaagccgagatcgatgtttaccttacctaaagttaaaccttgtgccttgtgaccagtgatcgcatagcccaacttgaatgggtattgaatgtattcaccaatagatttatcaacaagaacagtcttttcaaccatcttcttgatcatctttttagtcccgtccggcatatcaacctcttcctcttcaagcatcatctttttctcaggtacttgagcaacgttgttccatgttgcaggaccaattgggaccatcttgccatcgatatctacaacaacaaaggtttttgcgatacgacgcacaataccgactgtaccattgacataatcaggaactttcttcttctgatcattgtcgttaacaacgatcattactttaagaccttctttgagaaagagcttttcgttaactggacgttcaacaaactcaccagtaatacgagcattaaattcatgctgttcagcattaatctttgcgtattctttgttgttgatctcttctgccagcttgttcgtggtagttaaagttactgctccatcaagtggacgaccaaagcaacgctgattaaagaagttaacagcatcggggatgttcttcccgatacggatattattaaggtgttctgcaaacacaggatcactttgacgatgcactttgggaagataggcataggtcaaattcaaggattcccaactttcacaaccaaaaggaatttccttgccatgtagctcacggaacaggggaacttcttctttcttaagaacaggcttgatctggaaaccatcgccaaacatgatgatctggagtccaccaaaaggcttatcggatttacgatgatggcgaagtttcatatcgatttccttcagtttgtcacttcgagtcataccgatctcatcaaacacgataccatccagtgcatcagatgccatgagcatagctgcctttttagattttgccttataatcctcggaagttgtgacaccaaaggttaaaccaaacgccttgtgagccgtaacaccacggatgtttaatgatgctacacctgtaggaccaacaaacagaaaactatcggcaaagaagtcacgcaatgcagcgatcatcatacttttaccactaccaccaggtccggtgataaaaacgttttcaccattcatgattgcctgcatcgctgcttcgttaccgatcactgtcttagtcattatttagttcctcatattcatatgggtagagtagatatcctttgttgtcttttagtgctacggctataacactctcaaggtaaaaatcatcatcatagtgaatttcttcaattacaagaatatcacctttctttggatggtcatcgcgatcactgaaatcatttagtagctttatttttacgtttttcatataacatctccgctgctacaagggataagatcattgccatatacattacaatagaagtcacgctgatttcaatgaaaacctcgtcggttacatgatcaaagtaagcattctttacatatctgacacctactagccaaaatgtcatcactacagcaaatgttagtatcatacgttttatcatttctttttctcctctttatctttgtaaaagatgtgattttctatggtgactgttctctttagaagtttacgccaaacaggtttaaccttcttagtatgatagtacagagatccgtgcgttgggtcaaaccttttatacaaaacctcattattttttatcttatgtacaaacttagagatgctgagcgcaccctcccaggagtctttatctgttatgctgtaagaggatttagttaatgtccatgaaaactgagaggcttgatacacaactcctttcattgttctcgggaatttatcatttttcatccgattcattgtaacgaaggcaacagccatttgaccatttatcgtctcacctcgtgactccatataaacattacaggccaaggcatttacagaattatcctttttcgtacatttatgaataaccttctgtgctctctctttggcataagtgacgcctggtgccagagacagagtacaaatcaaaccacataaaactaattttttcatttttcctccaattgaggacccagcttatcactgggtcaccctcttgtcaactaccttcgatatgcttctgaatttgatcagcaatacctttccacaaaccattaaggaaagggttacttgtgatgatttcgcccaaccaagggccatacaggcggtatacgtagtcatctgtgatcgcatagatacttccatcacgtacagcaagaccccgtacaagagaggttgttacacgacgacccgcaaaccctgtcttttggtattccagttcggagtgttcaatataacctaccagatttaccagattttgagttccatcaattgcaaacccgcatttcttttcgaggtcttctgaaatcgtactaaccccttccagtgcaaagttaccaccgaattttaggccatacttagctgccagtttatcgtgtgctgtcattttacactttccttgatcagttgttcaaaagtttcaacatcctgagtgatatgtgctgtacttccatcacggaagacaacaacggtagtttcttccccaaaatgattaccttcacgaaagagaagaatctcttctacacgcagagcaactttaagaccaccttcacctgccaaatttgcttttacgaacattataaacctcccatgctacgaagaataacatctttcatacgaataagaatttcattcttatccacctcaggaaaaatttcaaccagtttaataagtaaacttcttccacttttatactcacccgatcttgcaaggtgtagaacagttcttgcaaactctaactcgtctaaaggtacttttccttcaaccattccgcagcctccttcaagttgtcaaacaccttgtaagcaacacctgtgtattctgaactccagtcgtcacttgggtcataatcctcgtcaatttcttctacatctacatgatacttattttcatagtccttttcaacaagaatacgaagatcatgataaacagatgcttcaacttggtctgctattttatcaaagtaatctcgatctgtcatctttataccccacaacgttggagaaaagcttcgcaaatgcacaaaaaatcttctttttctacattcttgatatccataccgatttctttgaaaagtttaggaagatcaagagccttcgcgtccttttctaacttgaaatagccgttcttatcatacggaattttttggaggaatagaacatctggattatcagagccttttgtttttgttgctagataatcataaatatcttcacgaggtactggcttcttcatattattctcctgtcaaatttaatttgtcaccttttcgcatctcaaggaaggctttgagatctccaaacttagtttccgtaaacgcagaacctgccggagctttgttataatcccatgtttcctttgcttcgtcaatatctcccacacgagattcaattttctttctgaattcgtaaacggaatactttgaacgaataactttcggcggtacgtaacgcataatgcctgcgtcgcttgatctctttgataatgaaaccttttgttgatgcattttaacacatcttaaaacgtactcctcgaattcctttttaaaagccaggtgaatcaaggattctggtgcagagaagtgaaccttgcgataagacccatcatcatccataaggtaacacacttctggttttcctgcaaaaacttcaacatcaaaactttcaatctggaacttcataaagtaaaacccccatcggttaggataggggtatattacattggttactctacagagtcaaccgtttcaacaaagataatatcaccatatttcagcttacggcggttgtcacctttgtgggtgtggtccacagggttaaatgatccaatatcattggaatgtttccagccagatttaacagaaaactgcttaacaacagcagcaaagtcttcaggttttaattcaatcatgcgctccattacatacctcctttcgtggtaaacttcttcacagggttattttactcgtcaacaactttccaactccaaagataaccatctttaggcatagtggaacctttaacaaatatcatttcgtcataaagatcattttcgttaggcaaatcttctaggagtttaaactcaacattgttatactcattatagatgatttgtgcacggagtttcttgcctaccctaatggagttagtttctgatcgaacacattcaataatgtatcccttttcataagaaatttcttcacgagataccttatagaccttgaccaacgcaggaaattccttttgtattttcaaagctgtatgctgcgcttcttgttcactatcataacccttgaaaaatttaaaaacttcaccttcccacttgatccagacttcatattctttttccatattcacctcttaagaaataagttggatttttggacctttttctttttctgcttgacgcaggcgttcacgaacgtagagttcgatatcggttggtcgccacaattcaaccataaccacatcaaaacgattttcgtgagcaccaggttgtttattcatgtggcttgccatcagatctgcactctcttgatcagcaaatacagcttttgcgacaattgctttaccgtcttcagtttgtcccatgctcatgctcgggatgttgtgacctgcatcattatcacgaatagcaaacacaagagtagtttcagcatttttcagaaagtcagtcattaataatctccacgtcagaattgatatcagttttataaaacagtcccagagtttctgcgacctctatgaaaacagcatccccagacacaactgcatcagaggttgcgtatactttattataaattggctggcctgtaaagtcacaatcaacaatatatttaaacttttggcctttctttacatcacgggctttgatcagcttaacattaatcatcggtactccctatttgtaatggtacaatacctaaagcttccaagcctgcctctacaaccttacgatttacagaagcttcgaactctgcttgtgctttcgccttaacaacctcggagttttccttaaacacgttgatcgcatgttgagtgatatccggcagctttgaatgaacacgagtgatcttattcttaagttcagtcaattctttctttgttgccttacctttctcaataagttgctggacttcaattacggcttccagatggtcctttaaaagatcttttaagtctttatccacgtttaagccgatcatgtcagaactattttgttgtccctcaatgccaggaacatatccatcgcccttgatatatcttaatgtgattggtacgccttgtccactatgggatgccactaactctgcccattggtaagatgttaattcaatctcaatgatacgagagtttcgtgacgtataataagacggcaaaccataagagatttcctggtatgcggtatcaatgcgtaaacacacacgttgattatgggtcgtatctgatccaaacatttccacattcccaccagttgggtgagtgattgatgccaacccataagctgggtgtgtctggattacacgctcaaatactccagcttcagataattttacttcgggcttcattacgtttctcataaaatcccctattttatttttacaatgtatttagaagttcttcggattctttgggtccttgtccaagttgggtcaacatactctatttctgccagacccttactcgggatgattctggtgataatccccttaaatatggttttacgatcgtcatatgtaaaagctactttgtcaccaactttcatctctatacccattaaatctttcaaatcatcaaccccgtctttctttcagttcctgtaagaacaactcatcagcaagattatttaaactatttgccagatttcgggcttgttcacgagtaacacgaataccaacagaatcacaaccctcacgatcgcagtagtcaatgccgatcaggattttacctttttcagttgaaggtgtaatattaatttctgcctgataatctacgccaatatcctggaatgtcatcattttgtgtatacctcttgtatttctgcgattaatgtttcagaggaactggcaatttctgctcggacttcctctgctttttctttatcttcaaatagggccggatgaatttgagcatcctcaccacaatgaagacacagtatagcataatacttcatcacttattacctttttcttcttcatgcggcttaacaataatctcttcaataatctcaggatcaatgtttttagtatacataaaagtataaagcgccgttttcaaagcagcacgtttaccatagtaatgatctgcgatgccattctgttttgatagtttatgaatctccactattttgctttcaacctcttcgttggagatctctatatactcgactgctgacatgcgttcaataaatattgcattaagaccgtataacttggcatctcgctccacgtattctttgaatcgctgccactctacctcatctttgataaggtctgcaattttaaagattactgggtgcttacttgatttggtcatttattctcccctcgtttgttttgatagggtcatattacacgacccttaatatggtgtcaactaaaaattaaagaaacaacgtggtaaattacttgaggggcgatgatcaggaagtacagatcaacaaatcccgagataaagtgataagccttcagctttgtacgtttacctttgtaaaaatcagaggcgattttgaaatatttataaagagttcttccaaatgcaaaaccgatcaatcctaatccagtaagaactacaacaaacactgaaaactgtacgtcagcactaaaaacaccaacaataagatctaacattaaatttcctccaaatcagtttctacgacatagatacctggtaaaactctataagcccaggtgttaaaagtacaagaatacataattccttttaccctgtaagttttatttgcaaactggcttacagggtcagtgactttaactacggtgtcacttgcaaacttaggcataccatgctttgaaattgcttcacgatcaactttgtaaacatccctcccaaagaacttttccagcgggcaaagattattctcaaaatcagtacccatagtcaacatctcctgtaactactgaagtgcttttctttgtcttgccgttcgaagtcttgatatgagtatctgcatgaggacaatacaccacattcagactcatatctcctgggttagctttgagacgataaatcttacaacctgcctctttcatttcttgcggtaaaatgtaattagtagttttatcgacaacgcccttttgatcacaaccggaaatgaaacatatcataaaaatcgtagcaataatctttttcattttacctccatcataaatactttaacttttcgtacctctaatcttgctttattagagccttgaagtctatttcttttttcaattgcgtcattaatgtcgccatagaagtagtgatccttacctattgttggtattccattgccgccttgcatagccagtgtatacatttcttttccaccttgcaacccttttgatactttttcttcaaaatatttattgaattgggttggtgaagtgtcaatttctacatcatcttcccatcccataactttatcccaaaaacggtcaatcttgtcaagaactttgttactaatctttttaatcttcttcaacataatcttccccattatttatttggataccgaaacgattttcgttagtggaaaagaaaccattttccatgcggcgaacctcttctttcatcacttcctgcatcgttaatttaaggatttctttgtttaattttggcttaacttcacgaagcttgtcaagaagtttttccatttcttcttttactttttcttcctcattttctatctctaattggtccattgcatctttgcaaacacagcaatggcccataactcttaaaatatgattttgtataggtaatgcttttcttccacaatacccacaaacaatagacccaccggaggatcgggcatctatcgtcaatgtaggcttggccccttctgcttgagaattccaagtctttttaccctggtaatcaaacataaagaattcgtaggatctttcatcaacatggtcttcgagcatatgtaaagttcgtgtattgaaatgtttcatttttaactcctcgtcgtttgtatgtgctaactatacgagaacttgaggggaagatcaatacttgatttgaattttattttcattatactgtgcacatctaaaacgagaaggagataacaaatgagtcaagataaagagttagccattgcgatatccgtagctgcttctgcccatgttgaccaagtagataaaggggggaatatctatattcttcatcctttgcaggtgatgcaaacattgcagcaaaagggaagggaagatttaatggcagcaggagttttgcatgatgtgattgaagatactgaaatcactatggaacacctctttaaaaaggggatttcagaaagaaccttagtgattgtcgatgcggtgacaaagaaacgtaagcaatcttcatctgattacctagaagggattttagagagtgagggtgcttgtcatgttaagcttgcggatcttaaacacaacttagatattctgcgaacttgtagcaccacagaaaaagacttgcaacggatcaggaagtatgtaacaatgcacttgttgattacggagatgattggttggtatgaaagtatcggaaggtatctcgattattgtgattcttttgcctattgtagctatctcgacgaacgtaaagaatttgttcagaaacttattaaaaagtggaaggagtttaaatgaaaaaggtattgagtattgagccgttcacaacaacatactttgacgatttggaacgtcatggtgattatggggtacaagacgctgatggttggaaagaattccctgaagaaacaaaaggtgacattacaaagctcggttgtaagatcaatggatctgaaccaaaaggtgtttacaccatgttttctttccttgaagctatgaacccaacgtacaagggagatcggcaatttggtttttcttttgcatcattccttacttgtagctgtggtcatgggggttgtgcaggctatcatgataatgtggttattcgacgtaaaaagaataccgtgatggtcatgggtaaaaaggaagatggttatgacgaaggtgttgtattgacaggtgaatctgttgtatacttcgataaaaagcagtgggacggtgttctagaacactaccttaaactcttcaaagaaaatcctgatggtgtttttgaagatgcgggttttatgtttactggtcgttgggggactaaaaatttttcaaaataatttaaaaacttgttgacttaagaaatagaaaagatatacttatcacatcaaaaacaagaggagatataaaatgcaagcaacttatcaacgtatggaccaaaccatgttcaaaaaacgtatcagtgttcgtgatatggaatcactgatccgtctgggagcttccatcggaaagaccgtattcttttttggtggcgctggtcttggtaagtctgaaaaagtaaaacagatcgctgattccatgttcccacatcgtgtaggtaataacctttgtgatgttcgtctgtcggataaagagccacaagatatcgcaggtattccgattccgatctcttatccagatccgaaaactggtaaagaagtcactcgtaccgtatatgcagttccaaacttctggcctaccgatcctgattgggaaggtatcgtgttcctggatgaactgccaaacgcaccattaggtactcagcactctgcatatcaggttattcttgatcacgttgcaggtgagcataagttcccgaaaggtactgtgtttgtaggtgcaggtaaccgtgatacggatggagcagggactacttctatgcctggcccattggttaaccgtatgatcattgcagaagttgattataatctggatgtgtggatcgaagactatgcgattccgttccgtctgcacccgaacattattggtttcttgaagcagtttccagagcatttctatactggtgatgtagaaaaccgaagcactccggtttattcatctcctcgtcaatggaaaacagcatctgacattctgtacaagtatgatgcgggtgagattaatgaatttatcgcagaggttgctcttgcaggtacagttggtgaaggcctggaagtacagatccttgcttatcatttacgtgctaaagaacttccaccgattgaagatatctttagtggggcagtgaaagaacataaacttgatcgtagtaagaacgaccttgtttacgtactggcacaaactggccttcgtcgcatggaagatgaggttatggataatgacatgacggatgataagttccttgagcgtgcaggtaacttccttacgttcatgtacaataactattatgcaaacaacaaggatacgatgattgctttgatcttgggcgtgttccgtggtccaaacgataagccatctatcttgactgttaacccgaaacgtcagaaaatgattccgcttatgcgtaagagttgcccgactgtttctgccgcagttatggaatacatgactcgctatggtcaactgattaaagaattcgaataatctcttgacaacgaaaaacagttaacttaatataagggcatctcgaaagaggtgtccttttttaatttggagaaaatgaaatggcaaaacttacgattgaagaaagcaacatgattgaaatgcaagtctctgaggcagaacgtatcattgaggctgctagtctacaactgatgcgctttaaagcgttctacggggtaatgctttcgtctatgcctgttaaaaaggcaacggagtggtgcagtacaatggcgaccgatggacgcaacctgtactatcatccagaattcattgcaggtatgacagaagaacgtaaaaaattggtactcgatcgactttccaaatctgagtccgatcctaaaaagcttaaagaggcaactgagtttattaatgttttttatcgacggaagaccgctcgtgaagttgcacttattcttgagcatgaatgtgatcatgtgatctctgatcacgcctctcgcggtaaaggatttaatcatgaactttacaacattgcagcggatcatcgtatcaatacaacggctgtgcttattcaccagaaaggggatgagttaggtaaagcctggttccctgccggagagagaacggtatttgataagaatgctgaatttggatttatggcctggtcttattgtgacttccgattcaaagatatgtatacagagcaaatctatgaaatcttaaataaagagcaggacgataaagaaaaatccaaaggggaaggttctggaagtggaaaaggggatggtgaagaaggtgatcaaggccgtaaaggtgttgatcagcacatggacccaaatggtgatccagaagattcagaagatgatagtatcgaagatgcactcggaatcgaccgtaaagcgaaacctaagcaaacagcagaggaacgccagtataacgatggggttatgcgtcgagccattgagaatgccgtacaggcagcaggaagcggtgcaccggaagatgcacgacgttttgtagaggcagcaggcaaaccaaagattaactatcttcgtttgttgcgtaaaactattgaacgtctgttcaaagatgatgtatcatatcgtcgtttgtcacgccgtagtcactcattaactcgaactcttcgtagctcgggctacttgtctggacgacagacaattggtttaccatcgaagaataaacagaagactattcgtgcaggtgtcttcttcgacgtatcgggatcatttaacgatgagctgttaagaccaacaatgcgtgagattcgtggattgtgtaatctttacgacgagtttgaggtcacgatggcttgctggtcaacaaaggttggtaacattgaaacgtatacgaagaagaatgtgaatgagattgctaactataagatcaagaccacatttggtacggatgtttcttgtgtgtttgaaacattagatgaaatgaaagatcctatggatcagatcatcatctatactgacggttactttgctgatgtatctcaaaagaaagattgggccaaaaagtatggtaagaatgttctttggatcatcctgggtcgtgggtcttcgttcaccccgccttttggtaaggcaattgattttgacaagtatcttaaataaggggaggatctttgagcgagtatacttacaagttatcagttggtaggcgtggtgtagttatgactatcaacatgattaatgaaagtgcggaggctgtaaaatggtgggcctccacctttaacgggaaaggatttactttatctcgccataagattgggtcaggaaagccgatagatcttgtaaaggaagacactttcctgtatcctgatcgtattgctgatgaagatattgatttcctatctgctacggttggtagtttgttggatgaggagccagacattgtaaggttactctctttacttacagcaatgtggtcagcaggccatgatgaggaaagtatgcatacaatggtaaggaatacgttaagacgttggtctaagtaacaacatttcctttatgcccgtttaggcatacaatactatattagatgataaacccctcaacctgctcggttgcttcgacggggtttatatatctattaaaaaattaaccacactcacattcgttcggtacttaattttttaagtcaccacaaaattgtgttgacaccacaatgaaacagatgtagagttaacaagagaaggaaagtcaattggataagttttacatatactgtctaacattgggattgatcttcatgattgttggatcagtgggtaaagttttactcaatagttttggaatttattaagaggagatcgtaatgagagtacgtcaacatcgtggtacattgatcgaaagtttgaaaactgttaaacagattgaaggtacaaaacaagcccttgtggatcatatcaacaaagagttaggtaaaccattcaatttctctgttgattcgatcagtattgtggaaaaaggagttgatgagcgtatcaattggaacaaccatctgatcctgattgatggttttggtgtatttggttattgtgatcaacatcctgtttaagaggtgggtatgggtattaaatggtggttgtttgtagttcctgcaaatgataatgcaggcggtgatggtaaacgtgcagtcgcacaaacctatgtctatggtcgtcattaaggagttattatggatgcttttttgagtattgtgtttgcactgacagtggttgattgggtatttatcggtatctatctgctctgtattccttttgtgatctggttttacattgaccttttggcaggtactggcaaagtaactggaatggactacttcatgtttattgttgtgatcctgatggggcctttagctttgttgtcttttcttattgcaaacattgtggtaagagggggcgctatcaaacaaactgttcttttaaaggtgagtggaactgatattggtaagaagatcattgtctggaacattacacgtaagcttaaaaagaccaataccaaatgggttaatcctttagaacgagccgttcagaaacgtcacaaagtcttaatggagagaaaacatgggaaacgaaatccgtaaaatcaagtggaagttttgggaatacgcattggttgtcgctggatatcttttcggttacaatcatgaagtgtactatggtgtgaagcataatcgaaacatggcgtacttcgcttggaagtttccagagcgtaaggaaaagaaatgaaagtcacagaaagcttagttaaaaaggttcgaatagaagaactccaggaagaaaggctcgatcctatcgaggttatcattgagaactacgagaatggcagaggtaagcttatagtcacctcaagtggcaagtcttgggtaggccaatggaatgcaatgggaggtagtgtagagtccttcatccaacgtgtagataatgactaccttattggatgtatggggcgagcgcctaaattcattgaagacaaggatgaagatcctgtcttcattaagaagatgatcttgaagcaacgccggaccgattcaataactaaagggcaggcgagatgggcttgggattatacggagacgtttgcccctgaccgtgatcacatccttcatggggttccttttgcgcttcaacccttgagggagttagaagaaccttggtatctggactggcccacaaaaatcaatactgaatatacgcatcaaagtgagattttggatgttgttcgtaaagcaataaagccaaattaataacgagaaggggttgacgagggtcgccccttgagttaaactttagttatcaaaacaaagaggagaaagaaatggctatctatgcaaaactgaaagaaagtaagaaaagttattttatttcgatggacccatctaaccgacgtatgattgaaaatcatggtgaccgattcattgttcgaccttctgagaataacgattcttacttacgtccggtgggtccacgtattgagggtcagttcttaacatcccgagatatcgaagagtattttacattcttccctgaatggtcagcagagtcagcagaatacatcgttaacttggcgatcccgcagggtcaagtgtctattgatgatcagtatctgttgggtgatttaactggggactatagaattaaaacaagccacccgaatatgtggcgactctataacaactctactaaccctgatgattatgtcctaatcaagcagagtaatttggagaaatattttaccttgcaagaggactccttaaagaaagcactgaagaagttcgataattacacccctgcacctgtagaaaaagaacaggaagttgtagatacggatgtttttgaagttaacattaagcgcacagtcagagttaaggatgtggaagtcacagaggacaatctggatcaattcattgcacaacttactaaactggttaaaggagaataaaagatgattatcgatgaaagaacgcaagtagttattgacaagactttcagtgtacgtaaaagtatcattgcagacattagtcttgagcgtatcaccgaagagggtattgatacttctgtaaactaccccttggtggaagaagacttcctacgtaaaattatgaaacagggttttaccgaccatgttcagatagagacgaacaaagatatgtggttagtctttaaactgtctgccgatactgatcacgaacaagaattcaatgcggcattggcctggattcttaaatactgtgatgacaatgacctagaggtaatgtaatgtacaagcttccaaagaactttcgattctatcgtgatctgaaattaaagactgtactgtttgtcgagaatttagagttggaggagttttatggttttgaatggtatgaaggggatatgggagagatgaacctcaagaatgttctcgaattttggggcaatgatgatggggaaggatacagccccactccaaaacacgagctttcccttgttgagatcagagactaacaaaataaggggtctaaacaggcccctgtaagcataaacaagtacaagacgataaatgaccttaccaaagataaaaggtcctcacaaacgcatacaggagcttacatggcttaccgtaaatttgacccactgatcatttatgaagttgtcccaatgagtatagcgaatcctcatggtttgcaatcacctactccacttgatcataaaacaatgatcaggaatgcagagtacactttaagagatctagagaatgaggggattgaaagtgctgtgcatgggttgaaagacctgatccgtgaacttgatacggatgattctgttcaagaatatattgaaaagtcagaggcactaatcacgaagtttcatgaataccgcactaaggtatctcgtattcttgatgaagcttttgatccttcattaaaagacccgataaaggatgacaaggcaatactcttgcttagtcaaatagctgacgctactgacaacatggaccctggttttgtaagagccgatcatacctgtgtagatcagtttcctttaacctatcttaaatccaaaaaggcattcggtagtctggcttttgtatgggagtatgagaaagattcccttactcgttacatcaatcgggtaggtaagaaagatacttcagttacgttaaatatcttttgtgatggttccttgatgatccataataactggacaaaagaaagcatcctctttggtaaagaaagagatcagaaatttaagctggtaaactatatccgtttcgcaacagaggatagtaaaatgggtaagtcatttaaagaggaggactttaaaactttctttgaagactggctttccccaacagaggaagagatccaactcttcaaagctgtgaatggggatgtttcattcgacctgtacacactctttaacgagtgatatttgttcgctgaaacaaattgagatttcagatccaaaatctatttgagatatttccctgtgatatttgtttcatggggaattttcagatttcaatttggaattctatttgagatagatttaagactcttgccaatgtgtcccatctatactgtgtcgttactagatactcataccactagatcaactaagttgatgcttcacctacagacacactcttcagattcaatacgttactgctccagtatacatacgatacaaagcaaacatacgacactcatgaccagaataatttgagaacttgagaggtttttcatttttgagatcgtaacctgaaagctgtgcacgagaacttgagaggtttttcgatacagagattaggaacttgagagctttttcatttttgagtttgcatttgaacttgagaacttgagctacaggccagatacttgagcggtttttcaaatttcagtttcatttcaaaattgaaaaatttttcataagcataaaaatataggggttgtcaaggcctttgataagaaatttttcaggaggtgagaattattctcatttgcaaaatagcgggcaggggtggtgattgcctcgtgaaaccgtcctcatcaccatgaatatataatagcaccctttttgattcgaaagcaagaacattttaaaaatatttttcggtaaattttgggcgagctaccggcgatccaccttacaacctggcggcgatgcctggtatgttagccccgcctttacgccgtggggatggcgattgttttcctatgtgagcattatggcccctggcggggccgttgtcaacattattttttatcttcttgccaggtaagaacgcctaaccaaaaatacacgtcgcccttagcgttcggcggtatcttgctttctttcccgccagcacacgcccaaagataaccatcagtaaacgtgtcaaggtagtctatatcttccacctttcgatccgccaggctaaggatagtattaacgtctaaacctgttgcgctcgctacctggtagaccgtgccaccttgccagcctaacgagtgcataaggtgcaaagttgcagtggtgatggtagtcatagtatcgccctttcttctgttgttgtgcgccccagttggcgcggtaaaaagactataaatgatcttcctttatatagcaaggaaaaagaaattaaaaaagattaaaaataatgttgacgtagtgaatctggtagcgtagtattcatctcatcgaacggcgacatgccaacaagtaaacaaataaaagggcaacaaaatgaataaaagaattacaaacgtaaatcctggcgaacgtttccaacatgaggggcatttgcacactgtagtaagcaacaaggagcatactgtaagagttaatcgaaatatcttgcaattacgtgatcgttttggtatcgtacagacttacactttcgaagcaaataaaacagttaaaactttctgaggatttttaaaatggcactagtcactaagtatttcattgaaggccagcaagcggcgcaacaaggttacagccgtgttactcgttacaagaaagaagaaaacaaaattgaatttttcaagggttacgatagtgtaaaccgtgatgcaacggtcctacgcttcgaatccgatccggttggtaagcctgttacctcttaccaggcatcaccgcagattgtttatgtgggcactgttaaagaatgtaacgataaactgatcacattgaaacaatcggatcgtgctggttactttgttgtttacactgccgatggtaagccttaccagtacgaaagcaaatattttaaataaaaagtattgacagaaagaaagaagtaaattaaattataccacgtaacgccgcaacggtgcggcaataaaactgataggaatgaacaaaatggctaaaatcatcattaaaaaatcccgtgtatcttctgttgctcgcgtcgaaatggtaaataccatgccaggctaccggactcgcgaggaagcccgaagcgttgcaaaacagattaaagcccgtggcttaactgtaagtgcaccgaccaaaacacaagaaggatggaaggtatctattaaatccggtacactgtcgatcaataaacactaatagccaaaacattaacggggcaaatttgcccctcaccaaacaacattatccaggagtattaacatgactagccaaaacactaacattgaaaaaatcaacattactaaagagcgtaaagcatggaatgaaacattgaatctgaaaggtaagaagctgaataaaactaaacgcgatcgcagtacaaagcgggccttttgtgaatttacagcggatcaagaatgatgattaaagttattgcacttgttgccttattatgtatgccgtttttggcgcacggtgctaacttgatggattgcaatgcccatatgctggaccatgaaacaggcaataaatttgttaagcccttccagatcaatccggcggcatttgttaacggtgttttatatcaggaaggtaaggccagtacgctgataatgcactatgatccaacaacaaagaaaggtagcatatcaatccaggttggagaggtggaagagttttccggtgaaataatctgtaattaatatcttgaggcccgtcattgtacgggcctttttcttttatgaaaataatattgaaaatgttgttgacagtgccaacaaaaagcgtagaatgtatcacatcaggacggggcaacataagtagacaacttgtaagtcgtaagaaaaccaagtgaccgtcaaaaatagcttgaaatgaaacataaatagtaataagatacttacatcgaaggcgggaatatctcccgattcacaaataagagagaaatattatggcatcatatagcgcaacaatgatcgtaacgggcacaactggtaaacctatgagcggtggcggatcattcgctaacatcaatattgacgggcgtttatccctggatgccgcgatcgccgtagcgcaagaaacatttaagaaagaatgtattttcaacaagcaagagtatctaggcttcgctattgagaaaactactcgttttgttgactataacaatcctttgatgattgatactaacctaaaagcgaaagatgtagatttcttattgtaagtaattgacagcggcaagatttacgaattttgtagcaaatagtacttgcaaagcaattagattaacgtataatgttttacatcgagagcggcaatagtgccgcctcacatcaaagagattaaaattatggctatccttattgttcgtgtatccggtacagttggtaactcccaagttgtggcggttgtaaccagcaaaaacataaatgaggcaagcaatgtattaaacagatgggccgttgctaattttggtgagtggtcaagtgttgagtatatcgaatcttaccaggtgccaactattagcctaaccgatctcaatgttgatcgcttgttatgcctggatgaattgatttaaaaagtaattgcaaagtaagtcgaataaagtataatacattacatcacggggagaaatgattatccccagtaagaggaaactaaaatgaaaacttgtcagtgtggtaaaaagtctattgctggtctgcgtcgcggtgttgctttatgccagtatcattacaatactcaagtatggggtaaaatgtgggctgaccaggttgaagcagcaaagaaagcaaaaaatagttgacagcaagaagaaaaagagtaaactgtattacatagggcggcaatagcgccgccacatcaaagagagaaatcaaaatggctaatatccgcaccgtgttaaaaaatgcaaaagaagttttattttctgacgatgaatattttaatcgcaatatcaaaggcgttcggaacatcgaggacgtaaaggatttatttggaatcaaaggtaacgtatatcgtaaaggattgcacggtaataattttgaatataaattagctgatagtgattataattttacactaacgatcattagttgaaagttttatcacagcactattgacttaagccgatagtgctggaataataacttttatcaagtactgcaaatcaaaaagagagaatatcatcatggctaacaacaaaacttttaacggtcacaaaaacaaaactcattggaatgtttccttgtggattaataacgatgcatcactgtatcgactggctaatgatttcatcgccgctaacactaatcgtaacgatgcggcccgtcatatgatgttatttttagaacaaaccggacaacataaaacaccggacggattcaagtatagtactactgcaatccgtgccgcgatggttgggatgtaaaaagaaaaagtaaaagtagttgacacaaagaaacaaaacaagtaaattaatcacatcaggcggggaatggccccgctaaaagagaagagagaaatcaaatgagctttttatctatcgtgcagactaactttgaaaatgattttattgctcaagctatcaacattgacaaaggtatcccaaatatcaattttggtttcaatagtggtggttatgagagataccagtattttgtaactgacgatggaagtgttttaggtatcaatacggtgatggctaatatccaaaacattaatttcaatgatcccgatgagcgctcattctatatcgtcggtgtccaggtgaactacaatgatgactctttaatcgatgattatactggcgagacgttagaaagtgcttacagtgacgaatcagaagaagaagaataagattaaaaaagtagttgactgaaagactacaaagaagtaagataattaacgaatagggggaacatccccccgtaaacaaaagaaagagagattaaaaatgacagaactgattgcaactacaaagatcgaaggcgttaacgatgttactttgtcctatgatccttctactctggtttatgttgtgaaatatggcagaatgatcgcagaacttgattgtattgatgaggctttcgaaaaatatttcgaacttatcaatattgcttatgatgactaccgttaacatacaacgcaaaaatagaaaggtgataaaatgatcaatgaaaaaacaatcaatgacgttcgagaggaagttttagccgttgccgtagaatctggcgcacgtcaggcattttggaaagctactgatctttaccctgaacaagctgaaaatattttaaaccaggtcagcgttaaactcgaagagatgggcaaagtcaaaacaagtgagcgcctcgaccaaatcattaaagaaagtttttgattgacttttaacattgcccctattagtattcaggggcaagattaaaagaaacaaggacacaaagatgaacgatattgttagtatcataggtttactgggtataggctacgtcgccacatcaattacgatgagttacttcaataaaaggcgtgataaaatgttttgttactttgaataccgttaccgtggtaaggttggatcatcccgtgactatggtccgatgttagagattgatgcggttggcgctatgcagtatcgccagtcactaggggctgaaataatttttgaagtgtaccgcagtacagaagaagagatccacgacattattgacgagcgtcaatattaccacgaacaacaaactaaacgcagggcttaacatatgactaatacaaaccgacaaaaaatcatcaaaactaaaaaacttgatttcaatacttatcaagaatctaagaagaaagtaaaagataagcgagagaacaagcggcacgaatggatcaccaatacaatcgatctttaataacaatctaagcccattatgtgggctttttcttatggagaacagacatgattaatattctttcactgacagaagtgatccgtttcctcaaaaacaacgccctgggaacgtctataacgtatctaatcccgcaaggtaaagattatgccagcgttacacgttcaatcaccgctacggcttccagggaagaaataaaggtcagcgtaagccaattgttgattgttgatccatcatcttgcgagactatccaggcggtgaagataattagaaaataatttaaaaaacttcttgcatccattattgagggggtgtatattagtttcatcaagacgagataaagataacccaaaggtgattattatgttatacgaagtttttgctggattttgtttttatggtgctgccgccgttcgccagtgtgatgattatgtggttgagtcatttgatgatcctttggcgtgtgagattgttactacggcatacgagcaagatcgccgttggattaatccggcctgtatcgcatcgcctgaggttgaacctatgccggaaggtgaggaattaacagaggaagacttgcaagaagtaaaagaagttatgagctacatgattgataatctagacgctgaaaacttacaacgtgcattgcaaaaataatttgaaaaagtagttgactgaaagaaacaaaacaagtaaattattcacatcaggcggggaatggccccgctgaacaaaaagagattatgaaaatggctaaaaatactaacgtttgtgattacgctgatctggttactctgaatgcagattctaaaatcaacctgtcaaacgtggaagcggtgcacgtcctggcccgccgctggttccaaaagttatatggtaatacttatttctctttaagtgtagatgtggagatcgctggtaaattggtagaagtagttaacgtcccgtttaaatatggttatggtgatcatttcgataccgtggcactagaagaatttagcaaggttatcaacctagagggaaaagagttttcagagtatagttacctttcccgtttttgccgtgacaataacatccctgtttattcgaacgctgttgatgttaaacgcaaaaaagatatgtaattattattgacagcatagagaaaacgagtaaactgtattacatagaaagcgggaacacttcccgcttatatcccaggggtaagagaaatgatcgaacaaatcaaaactacgacggctaacgtaacgggtacagtatctcacttcattagtgatgaatcgcggggcgttccttattgtgcggtgcatgtaaacaaaaatggcgactactggttaacggcgtatggatcttattctttcggacgtagtgcacaccaaaagatcttggataaagtgcagccaacgggtaaaaatattaccgctgaaatgtttaataaatcacttgcaaagttaaaagcgtaaagtataatatatcacatcaggcggggagtgtttccccgccacaaaaccaaaggccaacaaaatgaaagcaagcatgatggtagcgactgtaaacattatcattggtaacggaactggacaccacgaaatcataaaaaacaaggcttactctattagctccctcaaaaacgacatgcgtttatctttgggccaaatccgcgcttactttcgtgaaggctatcagaaaaaagtagcaaattaatacttgacgcaaaagtcattttaatttaatctataacaaatcgacaaatgaggcataatcatgtttaccaaagcaaatgagtatttctttttagattcacttgacgaaagtatctttgtagctatgggcaaaaagtcaatggtctttaaacgcaaaaaagataatggtgactttgaagatagcgaagccgtgctaacagtcaaggaaggtaaagaacctgctacgtctgttttaatctataccttgaccaacggcggtgaagttatcgcatcaggtagtagccacccgatcccaaaatcggaagtgaacactgtaattattggttttgttgcagcttgtttctacgaggaaaaaagcaaatgaatccgcaaaatttatcttatgtaaattggcccaataaggctgagaagaaagaaaacttgaaacgtctggttaacttttatcgtgaagctggtcatagtaaagtaacagcggttaaaatggcaaagcgccaccttaacaagccaggtactaaactaatttaaaaaacttgttgacgttggcttgtgccgtacctataatggacggcataggcaaacgaaataggatttatagaaatgaaaaagaaaattgtatataactttgttagctttattgcgactaccctcctggctattgcagggctatctttaatcgtcgccgtaggatctttgtttcctggggcaataggtattagcatagctttcgctgcattgtctgtttttacaggatatgcagggattaaagttatttactggtcagaagattataaatattcaaactaaattgaggtgtaaggtgtataagttattgacctgggaaacagaatcatcgtcaccgatcagccggaccttttttgatttgtgcacggcttacaagctggcaaagggaggatatcataaggcccaaatcattgatgaatttaatgttatcctttatgaattttaattaattcatgcacttaaaagaaagttataaaaagttttaaaaagtagttgcaacaaacattgggtagtagtatagtactttcaacggggcgagatagcccaaaacgaaaaaacttgaaaggtgattatcatgatggcaattttcttagtttctcttctggtcgctgtatgttctgccactgctgccgctgtactttatgacactcgctacaatgaggaataataaaaatgaatattgtcaacattacaggaaaaactgaactccttaaaaatcttgcaccaggtgaatcaactgtatggatctgtaacaatggagaagtagaaaaacagatgagattgtttaccgccatttgttgtcggctgaatatgaaggtcacacaaatccgatcgatgattgttagtgtgggaaacattccgactgaatgcataattcttacaaagatttaaaaatagctttacaacaacgataaaatcagtacaatacaaatcaggcaataaagccgactaaagaaaggtaaagaccatgcaaactattatcactaaatttcttcctcctactaatacccgtggcgctcgcatcaaagcaaaatgttggttgacagatatcactatcgcctatccggtagccgagatcaacgaagcccataaactggcggcagaagtgttaattacaaaattgaagatgacaacagatattgattggaatatcgttgcaagcggtgaaacaccggacggcagcggctacgctttcattatcaaataatcataaagcggcgaaagtatgcaatcaccttacttgacgctattctacgccgtggcttaccctggtgcttttaaaaaggcacaaaataattcgaaaaagtagttgacggcaattaataatctggtaaagtgtaccacgtagggcggcaatagtgccgctcactgaaaaagggtaaaatcatgttagaaaaaattttcacggttgtaatcttaggtttaacattctttgtaggagtaactgcaacgatggctaatatgattttatctttcaacggtattggttaagaggaaacaacaaatgatcccgactattttccacatctctcgcaaaggcattaacatccattggatggacaatttaaacgatgcaattcgccacgctcatgagctttccttgttaggccaggaaaacatcaccgttacagatgagaacgggatcgagtattacaacagcgaagaagaagactactaatcaacagggcggcaacaatgccgccatataaaggaataaatgaaatgaaacaagaaatcatcaatacaattatcgacggttacaaagaagcctttattttcgctgaatcagcaacggatcagcacggggagcatatcgataaccttgatccttatgacttctcccaggacgcaaacgaccggatcgcccaggatgtaacagccttcattaatgccaatattgccgttatatctgaggcaatgtctgacggtgcaacagcgatccagatagggaatgatctacatcttacacgcaacggtcacggcgtaggattttgggatcgtcctgagatatacaccacggatacgggtaaccgtttgagtaatgccgctaaattaatgcctaacgtgtcagtttacattgggaaagataatctgatttatattgaataaaaagtattgacaagctgaatcaacctgataagatgtatcacataggggcgacaagcgccccgcctaacagagagatagaatcatgaccatcgccaaattatccgctgaagaaatcgaacaagtgttaactactaacctggaacaatggaaacgtgaggcagatatacaatcagcacaatggcttaacgagaagttaacaccggatgatctgagtaagattatagatcctcaattctatgaagatattcacgacacggcgttatccgttgaggatatactcgataagcattacattgctactgatttgcaggtttacgggcgtaaaaactttattactattcacgacatttacaataactaagggcggcaacgccctacaactaaaagggtaatattatgacgttagcaacatgtaccggatcaaaaattgcttgctttgagtttatggaagactaccacacgaccgcaatcactaaccaatatattacagtgatcacgcgtgacggtatcgcctggcatgttccggtttatgatggggatacctatgaagtcaccgatagcgacggcaatacagctatctttgttgtctaagggggaaacactatgcacaataacatcattaccgatcgtgccgctactatgcgccctggcgatcgggcacgtttacagatcggcgcttatccgttccctacttatgacttttgcaaagtaaccgctatcgaaaacaatccgttcgaacctgataccgtgatcgtatggtatgaaggaagaggtaataaatttgaagacattttggggcgagatgagttattgaatattctacgttattaatcgccgtctaacagccttaagcctgttaagctatgcaaccccctaccttgtccaatcgtcgcaccctggtttatgctggggcgttctacgttacagcaaaataattttaaaaatacgcttgacgctcgccaggtgagcgggtatattttatcacgtagggcggcaatagtgccgctcactgaaaaaggtaaatcagcatgaaaactatcacctatctggaatcaaataataaattttttgcccctgttgatgaaatcatcgaagccctggcaaacggtgagggtgtaaatggcttgcctcatgctcaattagtcggacttgtcaaggcaaacaaagaattagcctactatgtagaaaactttgaaacagcagttatatttacaaaataaaggttgtattcattccgcaactggtttatattatttgtgtagggcggcaatagtgccgctcactgactggagctatcattatggcctttacaatcacctcttacactgacgttgccaacattgctaaaactttcggccctgaagcccttaagtatgcggtatccaatggtaaactaacgaaagagcaatgttacctgattggaagctgtaaacgttgggcggcatctcgtaacatcgagattgaaaacgtaaatgatggtaacatcgagtatagcgttgatgcagtattcaaggccgtgtatttgggcggtatctataataccaaccttaatgatgtgcgtatcgttcgcactggttttggggcttatgatgttccagttcgcgaagctatggaaaaaggttatattaatccagctattttaagtatgatcatgactgaggccaaagaacgtaacgaagtacgggccatcctgggcctgtaatgaaatattaacagaaaactattgacacggatcgtcaatatgctaatatttatcacgtagggcggcaatggtgcagcccactggaaaaggtaaaaatcatgtaccagacaactaaaattggcaatatctatcacgatcctaaaaactcacgcggtacagcttggatcaagatgcccaacaacgtttggtattacgcattgaaagggaataccctgatgggtaatcgttggaagtggattaaagagaacaacaacattattaacgatgaaaaaatccaagaaatggtagcaacaggtaaggttgtaatgcaagaaaacaccgaccgccttactcgtcaattttaatatcaataaggggcggcaacgccccacgccaagaaaagagaaacaataatgagtatttcaatagttaactcatcggacattaaaagggctttatctgcattgcgttaccatcatagaatgaaagtaatcaatgatgagagttatttagattcatcgttagaaagcgatacattggaagccatttcaaaattatccgatttacataaacgcatgaccgaaagcaaccgatccgacttcatagggggcgaaatatgagcattgcaatgttaattaatgcggtagaagaggcaaaagcattaaagctatgtgttgaactgattgatcaaccaggcggcgatctccttgtgcaagtgtatcccccaaaggatgattctggcgcttatagttggtgctactctgacacgttcgaacaagtagacattaaagcaataacatcgtttatcaacagggccatacttgagcaaacgatagagattaacggaatgttaaaaacaccctggcacatttactaagttcgataaaagggcttgacttgttcggcccttttttgctattcttatcaaacgggcggcaactggggacaggggaaggtaatcaccggaagactttggcatataatgatagtaaataactatcaatactcaccaaaaataaaataaaatatatcaaatctttacaattctacgtattgacaccggatcaccgttatattattatttatctcgtagggcagcgaagcagtgatgcaaagtagttactctatgatgtaagttctgagaagtcgaatccgataaagtatcagaaagtttctaagttttcgaatcgtccagatgaaaaaggctggcaagtgttgagaaagggcacgttgagtaagtcccgaaaaggggcgctcttagacaccttctactgagattgcgatcaaagtgttaaactgtgagaaacaaaaagagtaccaggaaagaaaaaagttaaaaagattattgacacaaaagtaagttttgtactattatctatctcgtagggcaaacattcaaaacattaaaaagggtacaaaatgttacagcttaacgctaaattagacaaagaaatcactgagttttgggatatggtagtagctacagatgtagacggtgtagcaagtccttacctcaataacatcgagtatcacaatgttgcagctatgaatgcagaatatgcagaagaaggcggcgcggataagtttgctaaaagcaacggtttcactgatgctaatgacatgatgcgatcagtattgtggcaagctcaagaagattttgaagaaaaaacacttgaattcgccagacgttcataatagaataatcaaacgggccgagaggcccactaactgacctaacaggattaacatcatgaatcgcatcgatcagcttaaagtagttcagcatatggcctaccgtatccttgaagttcagaaagggagcaaaaaagaagtatgcgagaaagcgtacaaggtattcagccataaatctgacgattggaaattgcagaaagttaaaaaggccgatatcctgggctatcttgaagaagagatccgccttgcggagcaaaaacagattcgtcgtgatgaggcagaacataaccaggcctggcaggagtggtttaaaggatacactaagtaatactaaaacaggggccatacggccccctttgtaaatattccattaatttacaattctccctattgacaggttagtcagttttgcactatagttaagttcctggcagcaaacaacaaaacaaaggacaacagcatgaacatcaaatcaactaatccggcatactctttcgataacgctttttgtcacggtagcgccgccaaaggttttgaaattgacggcaaactggttatcgtcaatgttgatggggaagaggttgcagtttatccggtagcagacgttaaaagccgtttacaatgccgcatggacgttaacgaatatcgccttgatccggttcgtgtagttgccctagtcctggaagaagaaattaaagcaatgcagcatagcaacaagtttattggtgatgcacaggacaacatgaaagtaagccgccacaaagttaatgaagctctgaaagattttggttttaaagacttgatcgtcaaacgtgatgaaaaattccgctttcgtaatgatctggcaaatcgctactatgaaatatatgaagcactttaagaggtaagacaacaaggggccgctattgcggcctttatcatatccatcggcgtgactctcccaactctattaatcccttccctcatttggatcatcctactctatccaacccttctaacttactttacccatcaatctaatcagcttcctgaatctctcctataaaaatcaaaactaacctgatagcttaccacaacaaaacacacaaagaaagaactattttgcccacaaagaaagcagttttaaagagataccattgccagagtatggaggtggcgcgaccgtagggagcgacactataaaacgagtatacccctcctaccgctatgcggtcatcggtgataaccgatatcgttacacgctatctgttctcttcgtttcctcgttttatagtgtctaatcagtaaagaaaattagtctttgtcaactatttttataattattaatgattaaagtaattaaataattatgcatagctactgattatgtatgcaataaggatgcaatgggaaggtcgttagtgtgaccacacaaagaggctatagggtacacaaaggggccgtatttgcccacagaatgaacaagtaagcagggcggtacgcccttttgctagacaaaactctcttctctcttctctcccaaataaattttttcttgcttttattgccagagtatggcgggcgctcaggctattaatggccctgatggagtcgcttgtatacagttggaatagtccacagttgaatagtaacaagttgggattattcttcccacaagttggaacaggccagacctggcaaggcttgaggtcgcctcatttgttggactggaaggagggcgctttcagtgcgtataagttgtattatgttaaatgcagattgaaattggtattctaaatcagattcagaagtcaatagaaatctttaactttattgttggggtagcacaacatttttcttgacaagtcgaatcaaagatgtattctggattgaaaataaatgaagataatgcttgacttcctggatattttgaaaacatcggaccccctccccctcccccacggtcgccgtgcctggcagcacagccaacgcactaaacaaaaaagatgcaaacatcctgttcttgctgacgaggacaactgacctctactgacgtgactcttcaggccatcacctttgggcacagatatatttgggcaggataaataatggacccaccccgtcattagtgactcaaaattttggcgagagggtataaaaactaaaaagtgggcgtttaaaattcaggctaaaggtccactcagggtagacgtatactaaaaattctaaactgctggaaatcctaaactacaagacgagtggatgtatggacgtgactccgtggcatgaatgctactctgtgggcaataggcattactctgtggcaagagaggagcctctgtggacaatcggagtgcctcgataggcagaatggacttgactctgtgggcaaagtggtgtgtctcagtaggccaacagtggttactctttaggcaaactacctaattttgggatgaactgatatttgtgggaatcgttgtataatatttgggcattattgtatgcagtgtacaacagtttggaaggactatatagtttggtgggcacaacattttgggatgagcagatgagtttggttgcaatccagatgcaaaaagcacccacttttggggtgctctctgtagttcaggatcatacagccagtcgtcttaggacatacgttgtattgtcgatgcctaatatattaacaagcttaacaatcctgtagctctgggcttttactgacttgtattgcgatttatctttatcttcttgaagaatgatagattcaattccattattgtaggcacactcaaggtagctttgagtgaatccaagagcatctgcatccttctcagctatttcatagacaaattgcgcctctgttccgtcgtagattaccttcctttctttcggttctatataggtccgacgtacaggactggtttcttgctcttgttctttacgtttttcagcctcttctgccaaagatttacgtgtaccattccaacgatgtgcgattttacttaccattccggcctccaagtgatatcaactttaatttctacctgtgccaacacgaaaggacgttcatccccgctgaagttatgtcgccaagtcgtctctcgaatgtccagacagtctttgctcttaacgtcatagaacgtaaacgtacccgacttcctgaatacttcgtcaataggaccgtccacatgaccgaagtatgcacctcttttaatttcctgaaagttatagtgtgccatattaccccttaataatgtacctgtcaatagtattcatattcatcgcccatgtaccatgaatcgtaaccttgaccataggtgtatgatttagttggtgttttctttgtctgttctttagaaaatagtgccgtaccgtccttaaggaagccagtagcttcctctccttttactacgacacgacctttctttttccactcttcaaatgtacggtataccatatcaattctctccgtgctccgcttcgtctgctgcggtgataagtgccgccgccagttttcgtgctgcctctggtgtatagtacattaatgtatttccttcttcatattcgtcaggattgaagtctactgagacgagattgccgatcccagacttcttgatactgacttcggtttcgtcgaagtcaacgtcttcaatgcgtacagttttcatagtaatttcctctttattgttgataggataattaggatttaaaccctgatgttaagtgttcaccaagtgccctactgacccttctttatgtcagtgtgattcatcatcctttctccataatgtccgctacaatcatagcgaacgccagtatcagtaatggtagcgcgatcactaccccagcagtcatcatagttgctccagagccgacagcacggcgacggatgcgagtaacactaagataatgccccaggtcaagtagtgataccaattaggccataaaaggtagtcacaattctcccaacgggcgttcgggttatcgttatttccagtcatagaagtccactggcttaggatcaccgaggtaatctctacaataagtacggaatgaagcctttgcttcttccagagttaaccctgctggcatagccaggcttgcctcatcccaaaagatgtactctacgtgaccatcaccgtagatcacttcttcgatggttgccagattagtagccttcatctcaaattctcctcgattatactccgcatggaacttaaatgggcagaaaaattgattatctaacatacccgcacgacgtttcttttccattatagccccttactttttactaatgattaatttttgaatgttttcaacggcttggtcgaaaggaatttcatattcttcgatcaatgccagaagttttgcttttgcttcttgattgcgctcttcttgcacttctttaagaagttcgccatacttatctttcagcatttgctcagagatatcatatgcctctgccagaatagcatcgattttgtcgtcgagttctaaacattccggcgttgcagtcttgccacttgaccagcaagcacccatatagccatcaatgccgacgataaaatcattccagttagtatagtagcttactcccttggaaatatcgtaatcctgagctaaggcttctttgaacatctcatctgcaagcttctggatcagttctttacgatcaggggtgcaaaaagcaaagaaataactggatgtatgttcaggaaattcacgacgatagactgttaagctgtacattttgttctcctctttgatttgatatgctcagtatattagtttccggtatactctgcaaccttttcttgcaattctgtgtgaatttttgccagtttctgcattttgtccctgtcccaaggcttcttctcaaagtcagaaacagcatctgcgtatgtctcaataatcgccatcaggtcgtagtatttttcttgtggtgtcatgttagtctcctgtttagttgatgaacttaatgtacaggacaaaaaggaagaatgcaagcactttttaaaagctataggaaggcttctggcgaggttacctgagtatggtatacattcgggtaggttggtcagtttaggtcgttacgatgcgctctgtgaagcggtaggcaataaaaaaccgcccgaaggcggtttgtatttatcgaattgttattccggcaattccagaacagagaaagtcagaacctgtgtcgttccgtagccaggcaacaactgtgttgcctgtgcaccctgaccaacaccgtacagaacccctctgtccaagtagtagtttatagaatattcagactttattgaagaatactccccaccgtaaggtacaacaggatctagggccgtaaacaccgcataagtaggttggaaagtagtccctacaccttgcaagttccctgttccttgtcctgtaaaatatattctgccgttagggtgttcaacacgggcagagtaatggctgatatatatcttaggtcttgaaggcatattggagagtaccagtgttggtgagagaattgacacgttcgcggtactattggtccctaaacttttgttagtgtccctcccctgggcatagatatgatatgccccacttgcctccacaatcctgaaaaatccataggttgttgcaactatatcaaccactgttccacttacgttactctgcctcatccacgttgtagagttagtcgtcgttccattctgaccgtaagcagactctcctgctacataaacttcccctgttttagtcagaaggtaggacgtatcataagttgcccaatcaagatctattttttcaacattcttaaaatccgtcctcaatgtcagagttctcacaacagcagtagtcccaacacctaatccacccctgttattagtcccgcacattgcatactgcccatcttcgaatacaacggcaacgttacgataactcatgaccacttgtttaatagagagtccagcagggataggcatatccactgtaacatccgtcagggtatttagtgttgtaccaaagccagtgttaaaatactggttaaaccccataaacaaccacctatctgcggttgtccttgcaagaacagaagccgatgcagtccacacatctgcaatatttgttgccaagtacctccaggtgttcacagtggaactcgtaccactgaaatattggctaccacgaccataaagattaccagacttcataagaacaacgatacccgactgtccggcagcgaatttcttaactttaccctcaacctcaggcaactcacctatgcctaagttcatcatttctaacataatttttccttattcaagtccggtaagatcaagcgggacataggttgtctggtctgttgtgtaaccaggcaatttacctgtggaggcactaccagatccatacaaaatgccatcttctgccagaacgtaagtgttgtttacattacctctttgaaatatttgaccccataacggacttgctgtagtagttatacggttaataccatagtatatgggctgagttaatccccagcccgtcccacgagtgttccccgtaatacctatattgctatttatccttctaacaagtccttgggcgagagggtaaaacccataagcaggtgaataaacactacttgttacaacggatatagtatctactgttgtaacagtagatgctgcacccaacgtcccaaatgcgttgctacccaagccaagtatcaattcatccccgtctgtgcgtgagcctgaaatatatacgcactcatacccaacctttaatccaagtggtgctgagtttattgggtttggtattctaacaaaagaggtcctttggcctgtcccgttggaagaagaaaacttagagtaagccccgtttccacatccgtatacatcacccccacttataatccaggtagtaactgaagtatccaatattgcaacatctttaatacccaacgaagtattgggtggttcaacataagttaaattcgggactgaagtattagaacctaagcctaaatgggggcctgatcccgcaactgccagagtattatctgtataaaggaaagcgatcgcattagcacccatttctatttttcttatcggcttattgattgccattaccttagccgttacgtcaacgggcgtattctctactccaggtacgaagaagttataccctgtaataaaccacgatcccccttttgttttgaacaagagcgaagcttgcccagcccagaagtcatctacacccgaagagactaacgtccactgcgttgtggtaacacccgtccccgataagtttacatttgtaggtgatattgcgtacagattgccagcttcactaagcaagtgaatactttcgcttgctgtaatatcaaactttttcaacttaaatgggaccttacctgccgcgccggataaatttaacatctctaacattttattctccttattagtaccaaggcatactagccatgaggcgcataggtgtaacactggcccctccatcggggagtgtccatccacttgctgttctaccacctgcggcaaacaattgataatcttcagttaagataaatgatcgtacataatctttagtcaccccaataacctttttatctccaaaggttgcaggtttgtacatgtccacatagttatataccgatgtataagttacaccatcacctacttgacctgatccgttttcaccaccgtttttgatagtgtttctcccgaaacaaatgatcggagcacccgttgcatcacctgtttggatacctgatggatataataaatcaccttctggtaaattcccactcaaggcatcgttttttattggactaaggacagtacctgcgttgttaaatgaccctgtgcctgctgaaccttgggtgtttaacccactccaatacacatctccgtttctcatgattctccatgtacaaaccgtcgcaacaacaatgttcttaacccccgacataaccagtgtgggtgtttgtaagtgactattcaatgcacctcgtccactctcaccatacgcatcgtaccctgcaaagaattccctgccatcttcagttaagaaatgagtaccgaaagcccttgtagccaattgagatataggtcccatactggtgatctggacaaagtttgcaatcatatttcttgtaccgttcccacactcaccattagagttaagaccacagcagaaaacacgaccatcttttgtcagaaccctacaagatccgctaccgagcgctaaagtttttatatcgtcaggtgttacaccaatattgtcaaaatgcactgtaacttcagtaaagtaagcaacgttaccaccacctgttcccagcggtggaaatgcgtttctgcttccaacataataaaatttatcatcatttgttgcaactaatgtaccattctgccctagccagaagtatttacagtttgagtaaactaatgaaaagctcggccttgctgtggttataccgttaccaaatcgatactcaggggcattcccatacccgtaaagattgccagttggcctgtgaagatacataactatcgattgctgcgcttggataaattcaggtgaaatttcaccatcaatcggcggtagagaggccacagcacctaagttcaacatttctaacatttaattctcctgttgttttggaataccacaaagaaccccataaagaggttcctttgtttcattatctactttactattatacctgtttttccttacaaagtccaaaaaggagcgagacttactttcaggtactgtagacacatacccttgtttttcttcactattttcaaatttcaacgataccctccgtgaaaaacaatttcataaagtcctcttcccaaaacaccattgctccagagtgggtatcaacaacgaaagttctacgtgggtcacgataagtgttaccaaagtgaaactcaaatcgatcacctttcttgtgctgcccgaaatcctgttttaattcacaaaattgaacctgctctgaagaaatcatgttttgccccttattctctgtaacctatgatctttaccagtttgtcggatttatcttttactttactgtaatagtattcagtctgagatttactatcacactttgtcattgtgtaccaaaagaaaaaacctatccgtttttgcaaggcataagtaacctttttgcctgcatgtgtatgattatattcaattagtacgattctgtatctattcacaaatctattcatgaacttaaacatgactgcatcacagcaagactaggacgatgaatgtcgcaataaccatcacagcaatctcagttttggtaaaggtaactttgttggttgcaggtacgttgtttttccaaatgctcataaatttctcctcgtttagtaaatacctaagatgaactcgtcaccacgaaaaacgcccagacttcttgactcgttccacacgccaaaattgccagccaattcagaatcttcgtagttgtaaagcatctcgtcttcttgatcttcataatgcccgttgcgaatgatgttgtcaattactttcgttaaatttttaattttgttctccttagttattgtaattcttcagtatttcccacagcatgagccagttcactcaagaaatctttcaagctaatggtgtacgattcaacaagagcctctgcaatttggctcttaaacttcgaatcggctaactcttccatccggctatgtacgctgatgttcgtaatcagaaacttaacgatatagctcgccttggagagcaaagggaagtaatcttccaccatgttttcaatacggaagtatttttctgcgtagaattcccacataaaaacagccgtcagttctttggcaagttcattatcttccttagccattgcaatcagatgttctatctctgcttgttcaaccattaaatgacctcctctttaagaatctcacgatgacctgcgccgtaccatcctttcatcgtattaactacaccaacagcctcgccgtatgtttcaaatttcgattcttcatgtgggccaatacggacagttacccaaaacaagttaaatactttacgatgaacttcgtaatgcgttgattcacctttccgaactttaacgatccgaactttcattataccaccctccaaaagtcataaatgcttgatcaaccatatctttccactcagggtagagagcacaaatcatgatgtagacctcttcatcaatgtcttcacactcctccatttccaaatactctaccacaggtatgggcagaaggcaatttatttctttacccctgaatttcagacccttaactaattttagcatatcaatccttaatcacgtagaatcctgattcgttcatcaggacaaaggacttgccgaagaaatccttacgattatccaaaacaaggtagaatcttcgctcagacgagaggtgatgtgggtcagccatatagcttaccctcgccgtcatgcccttattcttccctcttgtgatccttactcttgtaccattctcatatttaatatccaccgaacctccatcgcaactctttatgaatctcatccaaccctggtttcagttttggaagatctcttataaactcaggatagaggacattaacgaagtcaatctcatcatctgtgggtttttgaatatcttcgaaatactcgtcaagattgaatatctgccaatccttacaccctgcctttcggacacccatgaagatttcattgttacaggtagccatccaggagatcctagatcctttaccattcgcattcggcaatgttgaaacacagaagcgtggtacttcctgaaccttaaaaccttcgtcatagtatccacgaccacgttgaaatttaaacttggtctttcccactctttgactaatcttcatatctcggcgaaagctgtggtcccccgtatagatcagttgacgaagacactgagtatatctgatctttttccaattccaatctcgaatgagtatttcatagacttccttaaatgcttcatacgccatcggaggattccttatctagagcaccaacaatctcgaactttgctacacctaagacaaccacatgccccagcgattgtacacctgtccacggagtaccattcttcttagttcgcttaccaaccacatcgcagaaatcattccgaagttctgttgcatcaaacaattcaccttttggaaaaacttctttaaaatcagcaatcacgttcagacatttcagtttcatattcgaatacccctctctctagtctttgtttggcaagtaattctctttgtgctctaaggggcatcctgaaaaatatcacgacattctccaaatccgctgcccgttttttaagccctttggtgaatttaccttcccgcttaattgcattatatatacccctgtactcctcttcaatggagttgtcttcaaatatctggttggataccatactatcaatctccatcccgagagcttcaaagccgtaccagtctacatgttcttctgtaacggggcctctctccttgtacacttgtcccgtaacttcgttaattacaatcgtcgtcatttaataatctctctgcatatcaaatataagccccgcagaagcgattttgacgaggttttcttaagagaatgataaatcaccttacctcgtcgtagacctcgttagaatcgttctgagggcgtttaaaccataccgagcaaattcatctcttttaacagaccttccaaggtagcattaaacaacactggcttaccttcctccggcttattgaagaagatttcatgagtttcattatctatcttctccatctcttttaccacttcctctgacaaaaagatatcactgcctcttaatccaggaaacatcaagagaattgcggtttttgcatctgttgcccaaccctgaccaccatccagactgaatatcttaatcatcattttcctccaaattagccagtgcagttctgacttcaagaatggttgccgcccttgactcgtttctttctgagaaatcacgaatcatcatcttgtacttcatttcttcttcagcacggagaatcttctgttcgatcaacttgtaaactttgcccgctctttctggaaacaacgctgcaaagagattccagtcttccaatcgaccttcgtaagactctccagaggtaaagtaccgatctctttcgatgctgtcaacaaaataataaccgaattcaccataacgccaagtttcatttttcatttgatgtaccgcgccgcagcagtgccgataaggaacccagcaggaactgcgacgatgatagcttcaaccattttcaggtccgctgcaacacaagctgcaccaacaacaacagaaccagcccagatagcaattacacgtttcaaaaatttagtattcattcgttagtctcctgattttgttaaattttcttttatttttacgtattcaattaaagattttgcgagatcaccatcgattttctcacaaaccatgagtatctctcttaccttttcgggatgaacagattcataaaatttccaatcctctgttctcccctctgtggtttgggaagtgaagtattcttctctgtctcgctccggtaagagataatatacaagacttagcttcctctcgtcaagcattttatcaccttattcgtaaaaaaccttatccgcttgttcttttaaccaaccccgtcggaaagcgctcttaagtatttctgcccacttcggatttgctgcctctaagagaagtacctcttctttctctatgttcataggatcagcaaagaaatccaaaatctcctcattgaagacaccctctatcaagatccctttatatttcaacgtcaaaagttttgccataaaaccttgagatattgctccctctctatcaattgtcgtagttgggggatttggaaaagggaaacccgccattggtgttggtgatgcacctgtcttcacaaaggtgttcccgccagtgttattgaagaaacctttcatatttttatcgtacaatgacattttctaccctctcttgaatttttatctctgcctcatctaaagcttcccccattgcaaggatataccttgaaatttcagggaacaacgcttcaaacatctctatctcctcttcaagtatatctgttggatcgaagaaatactcttcaaggactattcgttttgtcccgctcttgtcgccataagtaacaaaaacgaaacgatcaggtttcccaatagaatctttggatgttctccattgaaaaagatgcctgtttgaacttatgtttatccttttgtcagccttgtccagtgggattctaaaactcacggatgccgacattccttcggattgagtccatttctcacccttcttaaaaatattgttacggtatctgtttttacccaaggcattaaaagtccactgcctgctcaatctctcgattatctctttagttttcaaaatggtatgtcctcgtcaacaataaattttatagcattctttacagcagctttgttcagatgttgaacacgctggaagaacattgggttcaagtcaagaagaatatcatcatccccatacaacgccgtgaaaagatcgagttcttcatctgtcggatgcgtagggttttgaaataagtcctcaaacaccacttgggcctcatttcttttaatcaatacagttgaatcacgatagatatttaataccgtgtacacatcatctacgctcaggattttgacacattccagttctcctgtgtttccatcaagatacaaagttattgcaggagttgaccaatttgattcagatatcgcataaacgtagatgcttttgcgattcccaactgcaacagactcttcaattttcttttctgccgccttaaagaaaggctggtgcttgatccaatgatcccaaccaatccaacgagcacctttaccatacgcattcagaacatgattctcaatgttacgtttactcattaaaacccccataaaagaaaagccagccacctttcggtgactggcctaaagttagctactaatcaccacgaatgcagtaactatagcatacagaaatccaattgcaacaaaaattatcataatggggtcagaggttactcgcttaagttttcccatgaaagttgatctgcgtctgtactccttctccatcttgtttgtcaaaataatgaaagagttaacatgaatatcttcagcattttccgcaaaaggtgtgtacttaaacgtaccttctgtgtttgcgacgaagctgctgtgatactttttaccatcataactttctatgagaagaccatcctttgtcacccgataactgaccgaacggaacttgtcataaaaaacgtatgctctaaatccttcctgatcgggactggcccttctgacgaatccgtcaaaaaactccaatctctttccagaatttagttccacgttgtcagctaacatagggagttgacttacatatgtaaagtacataatgaccatccttccactaagctgaacacattttatcatattatgaaaaaatacaacagcgaagatcggtcatgaacactatgttgttaatttttacaacaagacttcaaaaaagtatttaaataacttaaatcgattttaatacatagaaaatacctatggaccagatctgacccatagggtataccttaatgtgaaattttattcatttcctcgatatttttgaatcgcgatcgaagtccttggttcagcaaggccagttccgtatgcataccatttaccagtgagtgtttttcgagcaccgtaggacccaatctccatatcgtcacaataaacatcgtaaccgatcggagtcttaactaaaaagagtacgtcacgaggaatccctaagagggtaaacatcgatatggcatcttttgcgatctcgtgagaaatcttctctgcattctttttactactggcacttctaaacagttccatctttaagaagatattgaaatgaatatcatcaagaaccatctcatcacggaagcatggtgtcacagccatccaactaccatcttccaacttcccctctttgtcgagttgaaggaatgattgctctgcggaagccactgcatatttccctttctggacaatgcgaagatcagtaacatcttcagggcatgtatggtccatagcatcgtcatccacatagcttgggacaaccttatcattgaaacctttacatttccaccaactatgggcatcaataaacaatgtgaagtcgatgtttgacattttagcctcgcttaccattctggaatgcacgtttagtaatttttgacatgaccatcaagtcttccagtgaagtatttggatgatacttatttaggtaggcttccatagcaccgaccagatcagaaagctctaccaactccatgatcttgcatttttgtttggctgcatccttaagttcatcaagttcttcttgaatcttagtgatctctccaagttctccacgagggaaagtatccagatgatagccaggtttttgttcttcgacctcttcatgtccgacaacacgaaattttccggcagcgaaacgccaaacaccttcaaaatacacaatgtaatcttccgactctacaatgaagatagtgtcgaaatttttaaatttaaaaaatccttcgacaagattatcttctgtactgaaacttccgaagaagttgagttcttgctccgtatgaaattcgataaccatattttcgttctggagtttagtaagtaattttaaaattttcattttctctcctcttatgggcaacaccgtggagatcttccacaaaagaattgccaattggtttctgaatctttgtaatttacaaatcctatccttccgcacccttgtccactacaaacagcctcacgaggatgatagtctatgctacaagagtgtggatggtcaaatgcttctcgtatttcaacacacaatcggcttaaccaatcgaacatttttggcatagaagcctcaagaagtttaagttcatcgatcgtaggtttatctttctcaaggaagaagtcgtctatctccgaaaacaaaatgacgttttgaactatcccgtcagttaccttgtaagagaactcctcagtaagtctcacagtaacttcctctatcagttctttttcattatcctggtcttttgccaacctttcttcaatccaccggataacgaagaatctttctcgctgaacatccatgttcagagtattaattattttttcatagattaggtttccttccataccttgtcttgtgcctccaggataagtttttcaacaatcttcagatctgttttctttggtaatctcgattgcttataaagaacatctgtgatcattttatctttttcttcagcccagtcaacaatttcttcatagcggtattcaccatttcggattgcgaggagttcttcagcgtctggtcgattcactaaaactttaccttctgtgaggatttcttcacccatccgaagaagccggaccaaatgcatagcatgtttagtgtcgtaaccgaacttctcttccagttcatgacgcttctcgttacgattcttaacccactcccagtagttgtggtgtttctccttggcccatttatgatcgtcagcacaatacttaacaatcatcagagtcttgcctcttttaacttcctctgggatttcttcatagtctagcttacggatagaaccatctttattaaacattggttgaacatcttcactacgatcttctacaacaccgtaaatgttaccaccgtaaggaaccaaagtacagaagccttccatgtttttaaatttacgaacaaagtcttcgtacttcaactcaccttctccgagatagctctgcaccagacggaaatagtcaaattgagttggtggctcttttggttgcggattattaatgtgtttgttgtgacccttgatccgctttaactgagacattgcataaccactgaagcgaaatgcaacttcacgagacagtaaggagtagaaatgttctttcatctctttccaagcttcatgctcgtaaagtgtagcattcgaatcagtaaatcccaattcaataatgtttggattcatcttcgaaaacagttgaaggaaagtacccaactcgtagatcttggcatcttcttcaccagggatgtttaactccgtcaccgtcttgaatggagtacgaaccacatttggcgttgcaacaaaaaccccacggatatcaatatcactaccttcgttattcgtaccatacgcatgagatcctgccagactcaacatcaagacctttgctacgtctggatgcttttccatcttctctacgatactttttacctttccagcactcacaactaaattttccatttatcctccaatcatgtaggtcacacaagccaacccagttggcctgtttaatctttataaagtttacgcagcttgtgcaatcttttttatttataggcatttcacaccataaataatcatcagtacgacaagtgtcaacgtatagataaaacttccgtaaagtccatgactggtgattttaagctttttcttaaagcacatcattgtactataaattacaccagtccagtgaatcactaaaatcgcggtggcaatatctgaaacattacccgcccaaagcatcagagagtatgagaggtacattgcaaaacctgatagcaggaatgtaaacaaataaccaattacacttttctttttctgatctacgattttatttttcatggtgtcgatgttcagattgtaataggcaactgccactatctggataatcagtcccaagataaagaaagagatcagtgtaacgtattcaaaaattggtgcagtcattataatttctcctcaataatttcagaaatgagattcgagatctcgaaagtttctaactcttcgacttgtgacaagcgctggaggcgctcgataacaaagtctttcttcacaaacacatccgacagatgctcaatgtcctgcttaccacgcattccgctaaccaactgcttgtatcggatgagttcaatatactcttctttagacattactgtcaagcgttcatctgcacaaatatgcaaaaatacttgcttgctgtcccagtcgaacccattgtgcactgcctctacttcacggcgtggtgtcccgcccagtgttacatgaccaacctcaacagggatagatacctgatcatcaggtcggcactgctgcaactcctcaatcaattcagatactttcatagttacccctgtttaagcttaaaagatttaaaggcttcgataaagtccatttctttttgcgtgtatttgtggtcaattgtatcagagaaaagagggcaacgaccatcaaccaacttcacatcccatagatgttgagggagaataaatgcaatggctgtaagtgcaccattcaaagaatcattctcctcgcagaaaaatgcgtaaggaatcttctctatgtttggagctaaaaatccttctgcaaaattaagcatcttagattgatagcctccgttcaacaagatcattgtttggtctttgctttgccactgatctacaaggttgtatctgtcatcatatcgatcggcatagtcaaagccataatgacctacaaggtttgctgctgcatgtgctgcttggatacctgcctggattcccatcatgtagctgtttaccaatacgtacatccgagttttcaattcttacctccaaagattcgttttgcaaatttttcattaccaatcgttagattatagacaactataattgaataaacaatccacgcaaggacataaaacaaaattaagaaaggccaccctacaaaccaaaataccgtcatgattaaccaacctagcatcaggagtttataattaacatttccgtgatttagagggtcaagtaagttagtgttttctggcagggggatacgaaatccaccctggcgaagcttgattaaaaagaaccagacagcagaacttataatgcaacataaaatataagtcaataaggttgtcattttttaactccaaatattttagccagtaatttatcattccctatagtgacactgcataaattttttatgccgaacaccaagtacgacccaattgtaacacagataataattgggtaaacaagataccagaagaatgttgcacatagccaaccaaccatgaccatacgtaaatttacattttcattgttcaggggttctaggatatacaggtcttcactatccttggggaacggaatgttaaaacccttctgccgtaatttgatcagtaagaaccaaagtgggcaactaacaagacaaccgatcaaataaccttcaaacattttcactctccttcatcttatcgatgtattgtgtaacgtaccttacttttacatttcggattctgctcttgatctcttctggacgtccagcaaatctttcagagatctctttactttcttttgagattgcaacactgttttgaacaatccctgccagggctgagaataataccaaaggttgagtgtagctgtcaaacattttttcaggaccccgaccacgagcatcacagatgcaagcatcaataaattcagagaggaatgcttggtccttttcaccacgtaaggctactaacaagtcataaactttctttggcttcatttctttgatacggtgaagtcgtgtatgatgctcagttacagctaaggccaacttcttccaattattggggacaccaaagcgatcacaaacttgttcagttaacttgataccatgttcttcgtgaccgtgcagtttacccgttagccaataaatacatttacctaagtcgtgacaaaggactgcccacttcacagcctcacttgcacgagtcgcctgggcataatccatgcaaagtaaagtgtgaacaaatgcatcaccttcaggatggtgctccttgggttgaacaacatcgtataaatccacaagctcaggaaattcccccagttgagtcaacatacggatcattaccgaaggtttattcatttctgactgatcactgaagcatttcttaatctctgcaaatttacgctcttttggcaatgcacttaaatccacactccgacacattagccaagtgtcaggatcaattgtaaactcaccgccgtatctggcatgtaatctggctagtcggtacacacgtaaagggtcttcgataaatgctttagtggatacacaacgtaaccgacgaagttcaatatccattgcaccattacaagggtcgataatttcgcccgtggaaatatccttggcgatcgcattaatggttaaatctcttcgcatcaggtcttgttcaattgtaacgtctggagagaacacaacttcgaaatcgtgataaccagggcctgttgatctttccgttcgagcaagagcatactcttctttagtgttcggttcaaggtacacagggaaagctgcaccaaccttagtgaatcccttctcaatcatttcttcatgggtcgctccaactacaacgtagtcacgatccttgctttcaacacccattagttcatccctcacttgcccaccaacagcatatattttcatactctttctcctcttaaatttaaagaccaatcttttatttcttctttccagtttgtatttctcttaatgtcttgcttttgaccacgaagatagttgatgatctcaagagggtcttgcttaacaaaagaaatattgtcgatcgggcactcaactaacttaagcatcctttcaaaacgattatactcatcttccgacttcggtgcaacaggaataacatcataatcttcaagattgtcgagagtttcaagagtttcaagagtaaccttcatctcatagccttctaatctctttgtcttgataccaaacactcttcgaaagtaaatgtaatatttcattatgttctcctagttgatgactatcattatacacatccccatatccaagtcaacaaaaaaggccacccgaaggtgacctttaaatttaagggtgaatccagtaaaaaggttttgttaaaccaagcttaccttttttatcccaaataaaataaccgtatgctgcaccatctgttttaccatcgtcagtaaaagagggtcgcttagataaagtaaccaagtgatcaacaggatattccttccagaactcaacacgtttggtactctcaaggaaacctaaacgaagaagcatgatcaccacatcagcgtccttgtgggccttctccacaaactcttgagctaaattgtaaggtggattagttaacacacaatctaccttgttgtattcagtcgcaagataatcaacacctgcttgaatctcagcccaagctgaaccaatcggcatttcattataaaaacgcccagaggctctgcaaggttccagataagtccaatcctgacggatcggaactaaattcaagaaagcatccactgcccacttcggagtttcataacgatcattttcacggcgttctgctttaggtttcaatgctgccactcttatttgcccccttctttcgccgcagtgatgatctgctcaatcaattcatcacgataataaacatactgctcaacaccaaaacattctgcaatctcatctaactcttcgaggttgtattcgtcaaagtctcgcgggttaagagtgaagatgttgaattttttggcgtagccttcgtcgaggacgatttcaaattctccttctccgatttccttcgcatcatcaacatcactcgattcgattgccccttcaaccttaatcccccctgtattttgttgatcggcttccatttgctttttaatttcttcatcttcagcggtcagacgggcttgcatctgagaggatgtgaagtaaatttcgccagcacgatcaaacagttcaacgagttcatcttctgtcataacacctttgtacagatcgtagtatttctctttgaacaggtctttgtagaaatcactacgtttaaataccagtgctgaatcaccacccatactcatctgaacgttgtggaacatgtaatgagaacctggacgacaaattcgaacatgaccagataagaagatcattgttgcagcacttgccacttcaccaataccgtgtgttacaacagtcgcctttgtttcagagatcgctgtcatgtacatatctgcgatatcacaataaccaccacaagaagtaatgtacagatttacaatatcaccttcaggtgctgaacgaatcaggtcaacagcctcgatatgtgcttcaggtgaattgtgcagatccgtaacataaatacgccaatcgttagaagttactggagacacccaaatgttttttgccggaccattcattacgatttcttccatattaatttccccttagctaattaaagtacggatgcgggtagcgttttgcagaacccagtctactacgacagaatgatcagagtcaacaattacttcatgatgacgtttgaacatatcaagaatctttgctgcttcggcagtgtaaagtgccgcacgatctaaaaagataatctgctctttaagttcttccgtgattggacataacttacttgggacctcaatggctgataaatgctctatcaactccgctctggtagagaacataatatcaacttcctgatcgatactaagagagcctaagaataagcgagaaaaccatccacgatattcatcgttgtttttacgcaaagtcttaattccaaatcttaactcttcgaacagggctgttgcaatttcttcaatacgatcaggaacaatagccccacaatttttcaattccatcagtttacgatgatcaactgttgcgtacatacccttatccatatcaccccttaaattccgattagatatttaaacttcccgtcgttctctgcgatcttgtggattacatagaaccaattttcaattccgtcttcatcttcctctttcacacgatcaccagttttcaactcaacctcggaaacgtactccttactttcaagaaaatacttccactgaaccatgtctttaaaattacagattagtttatttttgccatctgtcgtccaaaggccctgattgacccacataccaacaacgaaattcttttcttttttaggacgaccaagtgcataagtgttgtttaacatctttgctttatctaagaccacgttttgactccaagttaactaagaaattctcaagcactgtgatgttgtcttctttccaaagattaagtgttcttattccactcttctttgcaagattgactgctgtagcagtgccacccttgggattacccgttcttgtttcctttgcgtagtatatcacaaatttactttgcatcaagtatgcatttgaaagatttttaccaaaaatctggtgtacgtttctttcgtgcaacttccttgctccctgactcaatttatcccaaccaccatgaacttctttcacccaatcccaacgcatctctttatgctgtgggaaatctttgtcgatttcattcagagagatattatacaggtccttaagtccctgtccacctttaaagttattccaaggaacatatatctctgcaagtctactcggtgattgggtcatattacaatcttcatgaaacctctgcatacccctttggaatgctgcatctgcgccacctgcaccaccagatcgtaatgtgtacccaactcttgctaatctccaacctgcatcttccataatttttaatatttcttcaggagtctcccttgaacctattcctgtataagctggcactttaacctccttcatctccagttgaccagtacccattaacttttttccaaagtctttggttatctgatcccctgaatcttttagttgtaggtttgttttcatcatacttgccatccatgattaagtcaacgtgtttctttatttcctcatctaagtcttcaaaaagataccctgtccacaccatgatatctttactctcaccaaagcacgactttacttccttgataattctttttacaacatcaatattctcagggtcaagaggttctccacccataattgacaatccactgataaaatttcgagaaagatcttttttcaaactctccatatcttcatctgtgaattctttcccatagctgtatgaccaagccttttggttaaaacaacccttacacttatgactgcatccactaacccagagagaggttcttaccccctccccattgatgaagtctgtgctttcatacccacaaatattcaaacgtgtttttccctttgtaagacctcctgcatcttacctttgttataaggtcttgcatttggtgcagataaataaccagaaacccttcggattactgaaattgttccctcttctttgttaccgcaacaagggcattcaaaacctttagccgttgcatcgaactccccgctaaagttacatttaaagcactggtctacaggttgattaacaccgaagtaaggtatggttttataaccgtaatcgatcaacgtttcaagtgccttcatattatttttcaagtttggcgtttcaacataaccaatattaccgcctgaacttattgttgcgaaaccggattcatacttccacttagcgaaaggatctgaatgttcccaaacaggtgcatgaaaagagtttgtaagatagtctcgcttaatggcttctggatatttttccttaagcttggtggcgaaacgataacataaactctcagcgggtgttccgtagaggctaaaggaaatacgtgaacgctctttaaattcatcacatttgattttcatgtgattgaggatcattaccgctaaagccttatgcttttgccccaccataatatcaactgcttccgataagcctacatatccaatactgatcgatgcgtacccgtcatagaataacttactaatcttttcatcagcacccaatcttgctaaagcaccctccataaacagggttgggttttgagatgctttcacattcttgagtctattgacacgaaccatatgcgattcatatgcgttttccatgtgctggtcaagaagtgcataaaaattaccacctttggctttatactctgccgcaatcaatgggaggttgatcgacacaacaccaaggttgaaccttccatcatacttctctccatgttctgtcgtaaatttggaaaggaagctcctacaacccatacttgtaactttcccatctgaagatccagtaacctctttatttaatggcacagagatgaagtcaggatagatcctttcaacacagcactgcattgccatttgtttaaggttataattaacatcaccaggtttcaggtttacaccatcttgcaaaaagaagacaaccttcggaaaaactggagttaccttatccttgccaagcccctcagtatggacctttagatagtttttggtaatcattctaccaaactctgaagtttcaagacccatactgatcgtaatgaaaggcgattgaccgttaacactcattaaagtattaacctgataaaccagagtctgcattgcatcatacacatctcggtctgtcatctccattgctaaagattcattaggttttccgatcttttctaaaaactcgatattctttttgtgactcatctcaacatatgttttcaaaccctcatcgatatgagcacatgtttgtcctccgtattgactggatgccacagcctgaatgatttgagtcagaactgttgttgcaacaccaatcgacttaggtttttcgatcttcgcatttccaatcttaaaaccattttcaagcatgtcccgatagttaacaagacaacagttagttaatggactaaccaaataatccaagtcgtgaatgtgaccataaccttcattgtgccaagcagcgaggtcttttggcaagatctgattaatactaacatgcttgcttaaaatacctgccagcaagtcccgatgagtatttaccaaattgctaggtttgtttgcattctcacgagtaaattcttcagccgtttgatccaaaaatccgctaatatctgaataaagtttacctttgccttcacgaactgaatcccgatcatgacggtattcaatatagcatctggcagcatcttgaagatttttctgactcattaaggtattctcaacaaccttatgaatctcttctacagatatacgatctttatcttcaatctgactaacgacttcagtaatgagtttatcaacatcggctttagtgcctgcggataaaagagcgccccgaagggctgctccgatcttatccgtgcacaaggtttcttcacgcccgtcacgttttgcaataatcaaccttaattacctcctttaagatccttttcacgagccttaacaactgccttacagaatggactacgaacgatttcttcactagtcgcttcaacataatcggcaaagtcgtaaagttcatgacgatcaatgaattcgattgcccattctaatccagtttcacgattacgcatatcgttctgtgtgatatcgcctaagcagaacagcttagaactttcacctttacgagtcatgatcgtgtaagccgtatcttcatctgtgttctgaaactcatcgacaataacaaccgcattatcgaaagaacgcccacggatatattccagaggaacaaattcaatgttaccacaacccaactgagtttcaaagaaaccgtgaccgtagcgttgctgaataacctgaataagtgcctgaaggaaaggctcgaatttctcacggatagtcccaggtagtaacccgaggctgttccccattcccaatgttggtcgagtaaggacgatcttttcaatcttaccttgcttcagccaatcaataacggtactcataatgacaaatgtcttacctgtacccgccggagcgttaacgaaaacaacttccttctcgttaaccagcgataacaattccttttggaatcggttctttggagtaataggttttttcaactcttcataggctttaggtgttacctgacggccttttgaacgcttctcttcacgacgatcctgacgagatttacgattagtatgacgttgcatagagtacctcgcttcttaagggtagagtttatgagggagttggaaatgaggaccatctttaaatgaagtccaatcaccgccccactcaatcgggatgtttaattcttttgctgcatccttaacagcttctgccatcgggtaataatatttccagtcccaagtaaccgatccgttaaccaaaggccacaaatctacagcatgtccggtcagatgacgactgttcatcgtcttactcttaccttctgcaacatacttacgttgggtttctattgtacgtagaccttcaccaacagtaaagtcaatcgtactctttttgattgccagtttcacaacttcaaccaagtcgggatgaacgcccttaagacgttcaatactccgtttacctaatacaaatcccattaagtctcctagtgagtaacttcagtttttacataccccaagatcaaatcatcttggatctctttcatcgccacagacattttcaactgaacttcagcgatagcttctgaatattcaatttcgtctacaaagcgttgaagatgttcagtggataacgaatccatattttccacgatcgcattctgcattaccttttcgtaattttcagaagtcatcgcttcaacgatcttctgttgatttcggaccttaatgatatcttcttctgtcttatcttcaatacctttcaggaagtccagcgtcatcactgccacttcaaggtttgcgtcaattgccttaccaacaacgtactttgcaattttatgaagcagacgctcacgatcagtcagttctttttcaattttatcaacggtattagtcattacagatctcccaggtcatcgttattgaagtcaagttctactttgctcggcaaattctttgctaccagttcagtgtagccaccaacgtactcactgtcaataaaaatctgaggaactgtacgtggaacataaccaacagcatcgcttacctttttaaccatctcttgcaggttgacagagtttgcacccacgtcaatatactcatactcataacctttctgatcaaggagggtttttgcattgtcacagaatgggcagtttactttaccaaaaatcacattactcattatcaatctcctctatccagaaaacaaaactatttaatcacacttctttgaacgttgcaagcactgttgattcaatttcgtaataattttcacgaactttgatatcttcattcaatgcccaaggtacaccaaggtcagtgcttacatattggagatcatctgatccctcataaacagaattctgttcaaacacaaaaccttccactgcaaaagtacaaataagttttttcacttttagaatctccaggttaagggcctttcggcccagcttattaaagttcgaaatcgaagtcagatgcacttactgaagagtcaacctgaccagacagatattgaccattttctagttcctgtggagtcacctggacgtttttagtattcaggtggctattgatccaagggatcgggttcttcagtggcttaccgatgaaactatctaaaccaactgctcgcatacgttggtcagccatataatctacgtattgccacaggatctctttattcagtccaaccatcgaaccatctttgaacaggtattctgcccaatcacgttcttgctgtcgtgcctgtaagaacaactcacgggcttcatctttacaatcttctgcaactcgtgcaataaggtcaccttcacgaccactctgcatttcgttcagaatatactgagtacccgacaaatgcaatgcttcatcacgagcgatcagttcgataatgttggtgttgccagtcatgatactacgctcaccaaatgcaaacgaacatgcaaaactcacatagaagcggattgcttccagagcattaatactgtgcatacacagatacagtgctcgtgcatgtgcataacgatcgactggcaagttcaaagcgtaacgactgttcaactggaataaatcgtcatacagcttcgtaactgcatctgcacgttccagaatttctggagttttcatgatctcgtcaagaattgcagaaggatcactaaatacatttcgaataatgtgtgtatatgaacgactgtggattgtttcactgaaaccccaagtctcaatccaagtttccaaagcaggatcagaaacaattggaagtaatactgcattcgggccacggccttgaactgaatcaagcaatgtttgatacttaaggttactaatgaaaatatgtttttcatgctcaggcaatcccataaagtcaattcggtcacgggtcacatcgatttcttccggtcgccagaagaatgccaactgcttttctgtcagcttttcaaatttgttgtgtttttgcttgtcataacgagaaacgttaacagactcgccaaagaacatcggttgttccataaaatcaaactggtttttgttaaaagttgtgtaactcacttattatctcctcttcgctaatctgaaaaccattatacctaaacttaccaggaaatcaatagttatttcttaaaatttcaatcccatatcgtttaaagacttcctttgctgccataaacttttgtgctgcacttggatttgaagtatgaacaaacagaacagcaggatacaggatcggtttgccaaacacaagcttttcttctaacatttctaagcagcggtaaccttcttttgaatcttcaccaaggtcattgtcgaaatgccattctgttacccgacgatacattttattagggtcctcaaggaactcgataaactggtcagaatttttaaaccaggtggcatcatcatgcccgtaatctttcggatctctcaaatcatcaagccaaatcttcatcttttcctcctgtctcgtttatgtggtttattatacggattacgttatcaaagtcaataaaaaaccgccccgaagggcggttaatttcaattgtacttattgagaatcttaaacatatcttttgcaatatatttattgtctcgacaaccagcaagattgttacgaagtgcagccatatagatctctgtgccacaacctggatatttcgttccgaatctttttgcctgccgtttaaatgtccaacgatcaataaagaaccacgagataaacttcatattcctcctcagaaccaccccaaagggtggttattcattgtcacaatttacaagcgcctgattcgcaaccatcatcctcttcatcttcaccatcgcgagtttcttgatagtaaacagttttcaagccaatcttgtaagcatacatcaggtcacgcagtacaatcttaattggcagtttgccacctggataatcccaaggtttgtagaaggtatttgtcgagatcgactggtcaataaacttctggatgatagccatcaggttaagataagctgtcggtccgttcatatcccatttgtactcgtacaccacaccttcctcaccaacaccaggaaccagcgtcggaagcatacccgcaggtgacttcttaaacgtcactggaccacgaggaggttcaatgccgttggtagagttagtaatctggcttgatgtttcacaaggcatcattgtggacaacgttgagttacgtaatccgtgcaatgcgatatccagacgcaaactttcccaatcttgttgcaattctgcggtatgcaactgatcaacttctttcttgtagcgatcgataggtaagatgccacgagaataagatgtttgatcgtaccactcacaagcaccacgctctttcgccaactgaacagaagctttcagcaggtagaactggaatgcttccgcaagtttatgaacttcattggcagcttccggcgaactatatttaagtccacgtttagctaagtaatacgccaagttagtccagccaatacctaaagtacgacgcagtaacgttttctctgctgcaagaacagggtagttctgataatcaagcaggttgtcaagagcacgtaccgtgatcataacaggttcttctaaatcttcaagcttctcgatctttccgaggttgattgctgataaagtacacagtgcaacttcaccagaatctttcgggtccttaatgttattgatcggagccgtaggtaatgcaatttccatacacaggttggactgcttaatcggagccacttcaggaaggaacggactgttgctattgcaatggtcaacgttctgaatataaatacgacctgtctggctacgttcttgagctaaacgagtgaaagcatcagtcgcttcaagctctttgcgaggaatggaaggatctgcctccaatttctcatacagttttgcaaatgcttcttgatccgagaagaagtatttatacagatcaccgtttgctacgtttggatggaagaaactgatcttgccacctttctgtaagcgagtatagaagaacttgttgatctgaacaccataatcaacatgtcgtgcacgggtgctttcagtaccacggttgttcttcattacgatcaggttttcaaagtcccagtgccaaatcgggtagaagtagttagctgaagctttacgcagaccaccttgagatgcccaacctaaagattcttgatacattcgaacaatgccaaccgtacctgcatgtttaacttccccgccgcgaataggagcgtcctgtccacgaatagcaccaaagttcaaaccgatacctgctcgctgtgctgcatacttaccttgtgcttcaactgctgcaaagatctggttaatatcatcaccggactcaatcagtacacaagaactgaattgtcgagtcggagttcgtacaccacccataatcggagtaggcagagaaaccttcatggtagaaaccatattgtacaggtcaatcactttttgtagacgcttcttaggatcttctttactcatcaagcacattgcgatcagcatcagtgctgtctgaggagattcaaagatttcacctgttacacgatccttgaccagatatttatcttcgtactgacgcatagctgcgtaagtgtaatcaaaatcacggtcatgatcgataactgtatctaaaaattcaatctcttctttcgtgtaatctgaaataagatgttcatcgtatttaccgcgagctacagtcataagaatgtgagcgtacagtggacgaggttcaaaaccaccataagcctgcttacgcagtttaaacagaagcagacgtgctgctggatactgatagtttggactttctacactaattaggtccgctgcggacttgatcagggtatcgtgaatcgcgtcggtttctacaccatcatacatctgaatctgagatttcatcaggatatcagaaggacttacatcattaaccccttcacaagaccaaactacaacacggttgatcttctcagcttcgaatttctctacagaaccattacgcttacgaacagtaatacccaatttatttctccttatttagtttcagttttagttgcagacttgttgatcagggtatcatatttatcgacattttcaagtgtcggttcacctaatcgaacagtcaatccagaatactgatcgtggtaagtatcgtcataaccaaacgaatcatcaaccagatcattaaactgcaaccaacctaagtattcatgcttacttgcaaaaccacgctggaaccatttagtttgctcaaccggaactgtcaatttagctttacccataatatttctccttattatttaatcagtgtctcagaaaactcaggaagatccataacgattgtttcggaacgatcttcttttcgtgtgtatttacgggtattcactttttcaacaaccggaatatcaaaatccaaagaattaacaaaagccgtcgctttagaactactaacatctaggatatccatcttttcgtagatatctacaagtgggaattctgatttgtcacgtagacgtccagaaaacactgttgtttcacgacaaaggtacggcttatcgatacaacgtacattcactcggttaattcggtcaatctggcaaggtttgtactcacctgtctcttcattcaggatggagacttggaaaccgatcaggtgaagaactttacgaagagtcttgtcatccttcgggtcgaagttcatgatttttgcacattccaaaatgaaatccagagttactgcaccgtatttaacttctttcttaaaacccattttaatctcctcgtacaacattttaaaaagaggggcaatatgccccagcgccgataataatataaaattaactaaccaatgtcaacacttattttgcaacatgaccaggaattaactgacgatgttgaacaaaccctttcaggtttccactccagaagttaccgtcacgatctacgtgagtaataccttcctgccaggtactgaattgagttgggtggttaattgaccacaagacttcaccatactcattggtgtggtggtactcttgttcaatctccttcgcctgatgctcgaatggagaagcgtggacctttttaccggatacaagtttggcataaatatccaaagctttatcttttgtattgttaagacgacgataacttacctgcccacaacaagaggaagagatagacaaagcctcttcttcagatagcataatgtgatttccatcttcatcctgtacacaataccctgcgaaaatatgtccatcacccaaaggtccagaatcgaagcaatgatctacgtaaggcgtatgccacaccccaggctgcaacaattctggagtagaagctttataagcttcgtgcattttcttagccaatacttcgatcgttgggtctgcatctgcatcaacacgtaaccagaagaagttttcaaattctgttgctgtaacgatagtcttcatcatctggaacggctcgatcaatcggttagcaatctgcttatggaaccccgctgcctcgaaacgttctgcccattcacaggcattttccgcagccttggcccaagcttctcgtccggtacagtacagttcatgacacacgccacttgtatcttccacccaatcataccatactttaccatcatgttctgttcctttatcctgcataccaggttggttagcaccaaatcgaacaggcattgccatattttcacggatcagtttaaccattgtcttgatcggcactgcacgagaagacattgcatttcggctaaacagtcggtgcgtcataagttctgagtgaatgaatcgaggataggtcaattcaaacgtggtgatacgagctttactacggtagccaacagaatctgcaataatacgggcttcaatcatggacattcaaatctcctctctattaatttaaatcttcaacaaattgtggcaagtaatcttcaattgggctactcaaatcattttctcttacaatttccaagttagcaagtcttttctttgccaagtaagaaataaattccttagtatctaccctgtgtccttctagtgccaacttaccgtcaatataaacaccttcccaatcttcaccttcgaaaaatactattttcattttattttcctgattttgtaatcaacacgaacatcatacataacgtgaagatacatgtcaaacatttctttgcacatatcgctttttactttgaaggaagccaaaaggcttccattttctttagaaaggatctctacataatccccttccctaactacccaccttcctttaccacatctcaagattctctctccaaaataaattcagcaatcgatgcccaatcgctagttaccaagtcgtaacatccgatctcttcttcatcttgactgaagggtgtatcatacttgatttttactaccttgtcactaaattgattcaaaaatttattacgatcatcaatgatgtaatcacccgaaactccagccttgtactttgtagcataaaatccacacccgtctgttccattttcaaggtccaggttagggaagtgtcgcttcaagaaacgaaccttactgctaaaatgacctttcttgcaataagaaacaaaccgaatagggaatcctgcggcatgtaacttgttgattgcatctaccgcccccgcaatagggaacatcttatcatacaagaaaggatcttcccaataatcataaggagggatagccttcttacagcgatcagggaagtaccgagaaagattgtaatcaaaatacccattctcgctaatgtccttgtccataaggtcagaatcagcctccatattatagatgctttccatccagtgcaaccaaggccatccagaatcaacgatagttaagtcaacatccacaatgatcgcttttttcatttactctttcccctctgagagtttgataattaattttgcagtttcagttagcttaccattaacgttttcaacgtcgaaatctctaggtcgtgcactttcaggaaaattctcagagtaaatataattacgagaatcaccttcaaaagttaatttattacctgttcgtggatcagtacgatgtaaacggatcaaggtgtaatcaccatttaccgctttaactaccggaacactttcatgaataaatccaccatcagagctaataaatgtacaagtataaccatccatttccatacttttcgcaatatctttaacacgcttggcaagagcaacaccgaagtattcttccccgaagagaggcttcgcaacattctccgagatgtggatcagccagttacgtggggacacttgtttacctgcaacattaaaatatggttgaggtacttctttataatcacggtggtaaagtgcatcccacagttcacgattaatacctgcaatacgaatagctagatcgataagggaacctttaaactccacatgaatacccacgttgttgcctacggtaactaactgagcgatctcaccagcaagagcatctttaccagaaaaagcaggaccattcaaattgataaatttcatattaatctcctctcagtttcacaataaaaaaccgccccgaagggcggttaaatcaaaattacagaatgtttgccagcgttttcttcatcgctgccttctcgcgaacattctgacgatctcgtgcacaagaaccacattcttgacaacgataaatcttgaacttagacaagaacgttactgctgacttaccttcctcaataaccaggtcgtcactaccgcaacgaacgcaacgcatagttgattgatctttttggaacaatgcaacgttagggtgtttacgcatgaaaggtcgtacagtcaggtacagttcttccagcgttgggatatcgccaatgttatattcttccatctcctcaaatgcggttgggtcaccttcaacacaacgtcgccacagactaaaaccttcatgcgatagcttacgactatcaagttcaaaatagttacatgctgcttcaagtgcatttgaaggaagagagaaagcttctttcagtgcagccaatgtatcgatcgtaatgtaaggacttggtggttgcataccgtaatatgcgaaacgctgatttgcccaaccacggtcaaagcgagcattatgtgcgataaagatatcacattcgtcaagaactttccacaggtcttcgatcaacttacggtctgactggtgatctcttgcaaactcttctggatagtcagtcagcttccggctaaagatcgatgggttgtgcagccacttaccagcgaatgttagcatgtacggttccataattacctgcttcggtgcaatgaactgtttaaatcgtccaaacgaatatgcaatagaaggagatgtttcaacgtcaccaaggaaaactttagcacctgggttctgctctttgatcttttcaatgaaatctttttcaatcttagcaacaggctcaccacctgactctttctgctgcatatattctgcatagttttcgtaatcttcataagctggagtgatttcaaggagttccttaacacttgaaacatcattcttttgaatttcacgacggatcatattacgaaccgtagattcctgagactctttacccaattggcgagctacttcgcgctgagacaaaccgtgtttcatcagttgcagaacttgttcaacagtaaaagttactttattagtcactaaaaactccttatttaaaaaattcgattacatcggcaacagcaaagtcacggatatcttgtttatctacatcatacgctttcataaaccactgttcgccacgatgatacggcgattcaccataccacatcactggcgtaccagttacagtacgataaccacaatcacctttccaattgcgataataaaaccgcagggttggtaaaccgtaggtgttattgtcaacttcttgactcatacaaataaccctcctcaagtttatcgataaacgctttcacataaagagttatcatttcacctttatccaaactatcatcgataactacattgtacctcaataaagcgttcattgcaattgtttctttctttaatctcttcaaatattttttcaggtcagcaacaatctcaccatgaaactttcttgaagagtaatccctttcgagatagtcagccattctacgtagaacttcactcattgtcaagtctgttttatcttccatgtgtttagaccaaagtttttgtacaccaccttcgaaaaggttcagggtgcttccaataacacccctaacctttccatcaaagtgatcatggtctaaacaaggcttctccataacttcacccagtatagcacaaactccctgttggtcaagcaatatttcatcacgatattttgctatttccttcgacccactcacccaaagatccttattcaatttaacacggataggtgtagttgccttatccttcgctgtgaatagtggcctctttgaccgccgcttcctcactctcggtactcgcatgtactccctccaaggccaaagccattaagaactcaccgtgcgtaggcgcaacagggttttcaaaatactcttccattccgaagcgataaagtgacattggaaagtttatattactaaacagactgttgtcaacattatttttaaactctaatggaacgttcgaatcaaaatccttaaagaattcagatcgacttgagtttataaaaacccttaaagcattatcaaaaatcggattacctttttgcttcgtcaaataaagtaattctttcagtgaagctttatcagaaacagatttgaaagaatacccactgatgatgatctcgtcaaaacacatacctctgactttttgccaaaaagaccactgtgcagaactgatcgtctgaatgtgcatgttcagcttagatcgttcattaaacaggtttatatcgtaaccactacgatctttctgataagaaccaaaccccaagctatttgcagtgtgcttcagtttagcaatgaaatcccccctttcgagggtattccaacagatcactaatttcttactctggtaaaactcttcagattcatagcgttcaataaccgtttcgttcaaggtagcatctcccaattaagtaggcatctgcaagatctgtagacccgccgttcttacctgtctttgaatatccagctaaaaacccaggttccatcaactcgcaaaccttcatcatttgatctttatccattttaattttttccatcttcgtaccttttgcattcatcacttcttgttcttcaccaggtaacttacctcgtgcccaagatttaacggatgttggtgcaattgtgtgtatgttgtccatactatacccatctcgaagcagtgtcaactgaatacagaaaaataatcctgcaagatcccttgtcgcattaccagcagagccgaaactcaaagactccaatacgatcttctcaaccttaaaagattcacaaatatctgcaatgtgtctagagatgtatgccatctgctcgacagggttgtcaaatcgaatctgccagtccttggcatttgcagatccggtggtttttaatacctctttaaagatcggttcattaccgtcaaaaactacacatgcacaagaagccatactctgatcgatggataaaattttcacgctgattccccttcttcggtattatcaagataatgatactggtcgattaagaacacatagttctttacttctccgtccatgtaaaccataaaagttacatatttctcatcgtagaacggatcaccaacaacatagatctggcaaatagaatcaacacgtttatcaaaccattggattctccaaggctcctccagcatagtccaaggttcttcaatcttgtagacctggcgctttgcgccaggaacgagtgctgcacgaatttcgtcagcgatcataacatcatcaaaactctcagaaaaacccgacattaaatacctacccgttttaaagttgaggctaatgttgtcttatcattttctgtacgcttcatataaacacactggaaaatgacagaagcccactgaccagccgaaaacttacgatgattacccaaatgatccgtatattcaacaccttcggggaaccaactcttatattgttcaataatagccaaccacatactcttctcgtctgcacaaggagagataacttggaaagctgatgtttcaccaaagcgaagaccttcgaacgtctgatatggtttaacgttatcggctgcatcaccaaacagcatttggtaaccgaagaattttttaccccagccttttacctttccagactccatccagatctcacccatagagtcatcaatcaaccagagttcaggatgtttccaagtacgctctgttgaatcacgcatcgtgttaaacaacagagaaggaacctgaacctgatccttatcaaatgatgccacaatatgactaaactttccagtcttccgataatttaaatatcctttatatccaaggatcgataaataatcatctgcctcaatgccatctacaatgatcgcaccatacttttgctgaacgtatcgacgagtctccccaagcaacagaggacgtagagtatcttcacggttacccttatagatctcaggggtcgggagtgcaagacggaagttaccacttccacctaaaacaccaagcccgtttgctgatcctacgtgttcaagaatagcattgatcttaatcttcaataagtgaagacagttctccactggttctggagtttgcttttcaatgatctcgaaatcatcacgggtccacggagtaaattcttttccgcgagcaaccgcttttgcttccatattaatgttttggtcttttaaccacccaccaacaacattcttttggcgaccccaaaactctgttttgttgcgaaattctttttcccttccagtctccttgtgtcgagcgatgatcgttcgtttctctgcacctgccgcagcaacgtagcaagtctggtccagatccaacgccacgacaacattatcttctacaatacctgaccaatctttaattaccggataacccataaatctccccttattaaaatgcttcgccgtaatcttcgtcttctttaacttcttttactggccgcttgaatttgaaatctttacccatgtattcatacagataatcaatattcaaagaccattcttgcttacttctttgtcgccataaactaaattcttctttcaaataatcaatcgcctgatcacgagtgatgttgttaaccttcatgaattgacgaattgccctttcaaggtgtccattcttttgtgctaacccaggatgcatgaattcatgacaaggtgggcaaagacacataaggccgacaagtttaacctctccattttcaaaagtccactcttcatgacattctaccgcatgttttctcccattacctccctgaccgttacatatctgacaatgccagttgtgctctgcataacttttcttgcggatcttatcccattgggactgagtaagatatgaacgtaaattgttattccatgctgtctgtgggattatgcaaattttatgttttatatctaccattttcattttcctctaaagttgccttccagttcagggtatttttcattttttagatcgaggtaagcttgttttgcttcctcttctgttttgcaatacttcacgtactctcgaccacccctgttaagtcttgcttgccagcaattactctttttatgccaacgataacctttactcagtgacctgtttacgttgtttgcagatctatcgacttctcgcagattccaacctgcattattttgtctattcccgtctatgtgatcaatatctccaagaggccaatacccattaagaatgaaaaacacaactctatgcgccctataagttttgtcattaagattcccgtaaaaataattacgatctcctttcttacatgttgtgaaggcgggatctcctatctcagaccttattctctttatcttccaacgaagacctgtataacttgactcatcaacctccagcgataactttatattttcaagttcctcctcggttgggactctaacttttgtcatttaatatgcctcacatttaccaatcatattcatagcttcagaaacatcgataatcatatccgttgcttcgtcccaagctttccccaaaagattctctccataccagaaactttcatcatctaccatagggtgattctcgtccataccgatcccccatatacgatctctcggagaagcctctacaaactttaaaccctttttacggtaacctaccgcaagttcacggagattaccattatcacacatacgactatacactaaacgagcgacaatattaaatttattttcatcccaaaccgcctgatcaaaattctttaccttacgaccgagcgttttagcaccttgcggcgttacggccttaatgatcctttccgctgaagctttgtcaccgaaaagcatagccttttcatacatcatgtaatgctcaccagtgtggaaataaatccccttcatcttctggtcgaagtttgaaaacggagagatctcctggtaatgattactaaaaacatcacgataagaataaaagaacacatgtttatcagtgactcgcataaaaactcctatagatccaatgcagatattgaaattaagaatagcactaccgaaagtaatccatccggcgtactgaaaaatccaatccagcacgctcttgtgaacaggtagaatgccagtattaaaacgataatccctaagaatgtttcgatttttctaactcccgagccatgatcttagtaatgtcagcaaacgccacgtaagcatgtttgtaacaaccaacgtcaaccttaagggatttgatctcttcttccagtacatttattgcatggagtgtttgacgaataagatcaacatccttagttgttatattgggtgaagctgtcattaacttaagcctttctttaatcgtttcgatatcttgattatacattcacaatctccagtaaagatccaggaattgaaacagaacagttttctgccattgggaatttagcaatccaatctgaaaggctgcaataggcagaccaatcaaagtcttcgtcgaaaacgacaatattattaaattccacaccatcaagattaacaatctttttaataatcaggtcttcgatctgacttgccttaaaaagaccacagattttggatggcaagttaagtccccaccgttcacgaaattcagaatcttcaaacttgaagaaaccaactgcctttgccaagtctgctgcacggacctctaaaataaccaatttactcatttaatttcctcctcgatctgtgtagtgctgtataatctcatttaaacatttgcctgtcaacgaaaatttcttagctacatagcactcagcaatgtgttctttcaaatatttagagtctgtgtagcccatttcaacaatgaagtgacggatcttcgtcttgtccttatcatttaaagaattgaaataatcacttttagaatcaattattctcattttcaagtttcctgatctgatagtaaagagagtcaatgatctcttcgttggccttaatgtacatatcccgtaagaaaggtttcaacccatcacgcaaaatatttccatcacaagcatcgttcaggtatggatggcctagagcctcccaggcaggctgattagtatacgtaccccaaccctctttcatcatctggttaagatactcgatttgttttatcttaagctgcaaagcttcaatagtaagctgtttagtgttcatcagtaaaggtcctccgagtaaagttctttctcacttccaccacgttcgatacgtacctgtccggcataagttgcaataatcattgcttcttcacgattccaataattaccgtattggtcgataaagccttgatcgtctccacaaacttgctgagatactaattgtggccccaccacatcaagcacttctgccatatccttagagtaatgacgagatccagggataatcagagttccaccatctttcaatttaaaccgattagctgcacatacaatagtacgttgaactttttgatcgttattccaataacatgtttgccaacagatctcaggaatctcatccatcatatcttcgaaagagtaatcagcatttccgtatgactgtagtttttcaaacaaactctctggagtttcacgagacaaagctttatctaacaattccatacgttctttaaaagttttcaattgatcacccctttgtagtagaatcttgcttggtcatttcacgaagaataagtgctccaatattttcaagaagtgttacaagagagtcaacctcaggtaacttaatactcttggcttctttactcatcccatcacgaactcccgaaatttgcataaacacggcaatcatttcttttgtaagtttaatattcattttatctcctgttgttggttgatatgggtattatacagaactggtagcaggtgtcaagagtaagataaagaaaaaccgcccctaagggcggtctagaaatttttaccagtttgcataaccatcgtgttcatccgtatcacgatctatgattcgtggcttcggagtaagatccatatgagcaagaggcgtaccttctggaatatcattcagtgaatattcaacatttactagttgacctgtgagttcatccatcttttgggagatatacgctgcaactgatcgaccttccagagtagccaggtatttcagtttttcgtaagttgcgtcgttaaaattaatattcatatttgtatctcctttttgtatttttcattagaagggtcacactaaagtgacccgatcgttacttaagctaccagttctaaatcttcagcttctgcgtagaaaccatcaacgataacaccgtcctgacgtgtgaatgcaacaataacatctccccaatcttcatcgacgaattcaacaacgccaatatctccaaatcgaacaccagacaaactgtagcggtcttcataattacctaacggactgaacttaactgtctgacctggattaacttctttgatattcacagaatttctccttatacaactttaagatattaactttatattattcttcatcaacttcacgacccatcaagatatcaagttcgttcagttgctcaatctgactttcaagcgccgcacgtttcttctctgctgcatcttgcttatcgtactcgccgttaatcagggtacgcaggaatttaggatcaatgttcaggtcttctttagtgatcgccaggatgcttttcagatcttcagcagcatctttctgacgacgaacagcttcaacaccttcctgaacaatgttagccagacgcttacgaacttccaggtcagaaggcagggtagtgatcagttcgattttagatttagccattttgtatttctcctctttagtgtttaaatagtaagttaacttctttgcttcgatggggtaagaataccccattcaatatcttatgtcaagcaggatttttaagttctttaaaaacaacctgaaagactggaatttcatcactgatctctgacacaagcagagctacagtttcacaaggtaaagtacacgttgcaaatgtttcataacccgtatggatcttcaaggttaaattaccttttagtccaatttggaactgacggacaaaaggacttaatgcactgacatagatctcatgataaccgtttggacgacgagcatattttttaccactcgcaagacctgtaataactaaaccatcaaaagaaattttagtctgagaaccatcatacacaggtaagccaggtttttcaacatctttttcttgattcataattccccctatcgtacaaacattttaccctggtcacaataaccgtttttaattcctcgtggagcagacaaacattttactgcaatctctccacacttgcaaggagcattttcacgttctgcaatctttcggttctgatcgaaaacttcaccacatttttcacatttgtaagaatacaacggcattaattacataccctccaggtttgcttcaaaataagtgattggcttcatgatcttgccattcttatctttaaatactacacgatccataccatcaccaccttttacgatgcttccctttacaccttgataacggttacggttacgcagttcaatctgttcagcttccaaacgcaacatggcatcaagatcaaaatcagcttctgcaaaaaagtaatacgtcttgtagaaacattccgtaaattctttcacggttgggatcttggaatcatttgaatccaaaacctcatttaaagcacgacgagcattaaagttggagttctgcatgattgcaacaaccgccataacgatcccgtttgtattgtcactctcgataaattgatcaagagttcgataaagcgaagtcagattatacgtaccaacattgtcagcaggacagatgttttcagaaccacctttcaggaagttgtaatatgatccaactacaaacaagtcgcaaagtgcatctatgatttccttacgattctttttagttaaaccaagatcataaagttcattgtactcttccataacaagagttttttggaattttgaaacatcttcagagaagtcatgaaaaccacgagcaacaaaattccaattttttactcgctctgctgcttcccgaaagaagctattgcccttaacatcaatcatctcggaaataaaggttttttgatcagtactcaattcattgtatttcaatttaatctcctttcgtttaacttgggggccattatacatgaccccttatcattgtcaacagtctttataagtttccagtgcaactttacgtgcttcatccttttcgatctcgaacttagatcgtttgtccttttttgaagccttattacgtcgcttaacgattcgacgacaggtgtggtaaagtcgtgtaccttcataatcattcatccaaaacagatcgccattcacgaagagagtatcggagataataccacaagccttttcaatgtaagtaaccttacctgtgaccgtatcgacaattgtatagtcaacataccaaagactatcgttatcctcgcacgggtcttgttggccttcaggaacaaaaactccagaatgtatctcaaatcgaggagatcctttacggatcagcttcaagattttacctgctggcttccgagttagcagtaccggaacacctaagactactgaaaggtaaagtgtaatccctacaaacccaataattaaagcttccactattaaacctcctctgcaattttacgaagaagatccagaagagaattcgatgcctcgatcacttcttctagactgttggctacactcttatcaaaacgaagctcaacaaacttataatttaaacgtggcagaaatagggatttcagatctttattttctgcgtcagtaatgtcattagctttgatcgtaataatctgaccaataaaatactcacttggttttttacgaagtgcatcagtaagtccagagccagcaccaacctcaagaagtccatcacgagtacggcagatcagagatccaataagcccaggtttctttttgtgaggcgttgtcgccacaacttcaagatcaacatcgaactcatttttaagtttgatccctttcttagttttgttatctccccaaggcatattcgcttctttaagaaccgtaccctctttcttctgcaaacgcatttcgataaagtggtcaatagcctctttaagactgccaatctgacgaccacggatcatctggaaatgagaagactcatcaacatagttgacaatattttcaacctgcttacgacgatctttatattttttcttggatttacgtgcgatatactcgtccatagaaacaacatcccaaacaaccaaacgtaccagattaggatcaatgttttcaggatcttggttaagatatccgttaccgatctctcgtggctgaaccccgtgcgggtatgacaggtcaataactaaaccttccccgtgcataacaaaaggaccatcagaattggctttttctttcaggttttgctcaagtgaaggaatacaccggaaattaagctctttccctgatcgtgaacgataaatgatctgctcaggccaaaccataatgtctgcataaagtccgtccatcttctcgtcggagaaagcaccctcgtagttgaaattacgaaggagatcctctttgaaaagggtgtagctttggtaaggaggctctgtaatcagatccttccaaaccttgttggtcagggttgtctggataccacactcaagatcgcggttaatgatcttcagcagtgtttctggttcttcgcacagttgaacagcattcgtgagaacatcacgggcttcatgcccagtatacatacgacttgcaacatcgttgacgataagatcaatactctcttgtagattacggcttccttggtggaaagttgcaggatcaaccttaaaactgcgaacaaaaaagtttaactctttgctatatgctacccgaaatacttcacgcaggccatcattgtccgcatggctacgtaagatcgcttctttttcttttgttgatccggttgctgcaagttgttcgataatcttagttacgctcatagtttctccttagtttgctttgatttctaatgtgtattttgccagaccaaaaccaatcttgtcaagatcttctagggattttttaacctcttcaaagacctctttagttacattatttccactaacaatataccgtatctcaggactcccctcccccacaacttcgaaatcatagtccttaaaaaatacgatcactccggctgcaccattctcgtcactaccggatagcatgattccctcttcattagcaacttgaaaaattcgatctttgaaatcatataccttaccaacaacaaacttaagagagttaaatttagtcttgtagcctttgaatcggtatttcatttagtctcctttagttttccacaaagagcaccttcaacatagtcagggttctctttaaagaactgatcattcttttttatgatgacaccaatatttcgacggagaaatgcgaaagctttgatcccacgataccaagcgtcaaagctggacttcttcagttctccacctgtatagacattggtgaaataaaacggatgagtcttcttacttatcctcattgttccctcctaaacagagaaaagaacctcttctttctccacatgaaattcaaaatcgtccacaagattagattctcgatccttactttcatgataactacacgtccaacggtaaacaccaggaccagaatctgaatcaggtggaagaccaatatactccgcttcaggaccctcgtcaagcaatgcagggtgaatatttggtgctttaaggacggttacccgtccactgtaatcgacagccacgatccaaacactaccgttaggagattcgaaaacttcctcttctggatcttctttgataatagttttgtttggctttttcaagcaggttgccaatccagaatcaatccactggtttgacattccgttactaagccatttttcagacagactttttcttttttgtgacacgtttcttctccttttccacctttggtggtgctttctttttaggtttagtccaagcctttttaggctcctctggcttctcatacagcccaagcacgactctttctatcgcactcataggaacggttgtcatcttccgtctcttagcgtcaggaagctgtaactcccaaatacccaaccaataagagagatcatcaatgcgatcctgaacccaagggtctggcttcggaatagttagtagtctacttaactcttcattacatgtcaacaaacattcttcaagtttttcaactggcgtattaaaaacaaaggcagtcttgtcaaaaggcttcttctctgtcgtcatagcatcactcttcagtatcgtaggtgttattcttgattgcttccagtaatacgtccaaaggaacagtgaatgactctacagtgtccatcccaccaaccttatagccgtgaacaatctcaccaccttcacgattgcataccagaagagaatacccaccagcaatgttctcactgatctcgatatcaacaactttcatcatcagtctcctttttatcctctacccaaccataagccttcatacacccctggtaattaggccaccttttatttacaacgttctcaagccactcaagatccgtacttacatgaatgtattcactatatagttcatcaagagtgtcaacaagatcagggcggtctttcaaatactctcgaacatcactgatcctttttccaagcttacagttatcacattcacaagtcatcccatatgctccaaaacaagaaggtgcttataacgacggttatgtccatataccaacaatgccatatccatccaagcaacatcgtcagcgtcaccaatcacagagagacataagttgtcacagttctgtcttactttcgccacagtgagttctacaccccttccttcgaggatttcttcgaggtatttaaactggtcattcagttctgtacaccacaagtagaaccgaggcttttcctgtgcacgaaagatattttccaactgttcacttaattcatcactaaagatcaatttcatgatttatttttcctctctccgatacctttgttgagatacttaaccaaactaataccaaatgctatcagcatcataaaccacactgttccaaactcaacaatgttcaacccaaaagctacaacatcgttacactctttcatcagatcatctccaaagttattagtacattatccaaatcttcagccacaagctgtaagtcaggcttcatactatcttccacacgatgataaatcaagcctttttccacatactgattcattactccgtaatagttccccaaaatggtgtaccagtcacattcgtaaacagtcacaacacatactttcagtccagcttttgctgaatgccaagcttctctcatagcttgaagatgacttaattcattttctgataactttttacatttattattcaaaatcattataaagataacctgttgtttgttaaagtagagtcactatacctatttaaaaactccatgtcaagactttaaatttaaaaaatttagtataaaatctataaaagatcctttaagatctgtagatctatagatcatatataaaaagatcttataaaagatcttgtttttattgtttttaataataattatgaatgaaatgaataattattatataatttatgaatgaaatgaataaattataatgataaagggtttggcgagaggcttcgagccagggaaatctaatatagtattgtatgcctaaacgggcataaagggtttgacatgttgggatagtcatgtaagatagcagttgtgttggagagaggagggactatgtttgatataaacacctctgttgggaagaagacttttgaagacgatgcgttcgccatgcttcctcttcgttgggttactgaaatgtccggcgaggatttaaagaggatgatacttttgaggtggagattttcattctttgcggagtttgcttctcgacagggcgaatcagtggaaacgtgtttctatgagtcacaggtggcattgtgtgagttgtttcaaatgtcaccgaccagtcaagccaaggtaagtgcattccttaagaagatggagactggtggttacatcaggatttacagagataaggtgataatcaacgggaagtcgaaaccacgtcattacattgtggttaacgacccaatacttaaagagaagtacggatattgatggaggcaatcttgaatcaggtttcagaatgccgtttaaacgcaataggaagctctctcacgaaagaaacagatgaagtcatgtcttttcttgactggagtgcaatgaacgctcaaatcgtttctgagagagtttatgccgatattgcatctcagtttatgataccttgtaaggagattcaggttgagtctaagcttgaagaagaaatatctggacttcttcaatcgtttgagttacattgactatcattggttatgccagtaaaatggaagtatacttttattaactggttaactaatatgaaaaactttaaacttgcactggaatacggtgctgctggatacgtaacggaagagtatatcgatatctttgacagctatgacgaagcctttgatgaaggtaacgacattgcttttgagagtacaggcttttctctggagtgctggaaaaagattgactttgggaaaggaaatcgaatatacttcttctaccccaacgagggtgacttaacttctcgttataagatgacttttatggaggcaaaatgaaatttagcattacactgaactttaccgtagacaagtctaatgaaactcttgctaaagagatgaaagaagctgctgaacgtcaaggtagtacagttgaagaactctacaagacatttccacagcaattccttcagggttttgtagaacagttccctaatgacgattctgagtttcctgggttaactaccgaagttactgtttcggagatcaccaatgactaagcaagttgtagagcttaaggtaacttatgagattgactacaccaacgaagatatggcagagatgttaaaagctaagatggaaaaatccggcttgagcatcgaagaaattttcgaagctgtagaaaaagaactcgtcgaaggaactctagaatcgatggagttggagtgcaaaactctacctggtttcagtgtcggcgttgttaaactgtaataggggtaagatacatgattggatacggagaaggttgatgaaagatgaatttgatggtttcgtaggatggggagaaggttaatgggagaagaaaattgggacgtttagaaaagattgaagattggttctacggcgggatctctggatgctttgaagatgaacacccagacttctaattattttcctctggaggataatcctcgtaatcatgagtgtaaagattatgattgtctatgttattgctgcggtcatcgatttgcagggccaaagagaagcataatgtgtaatctttgtcttaacaagaagaaacctgttgacaataaatagataattatgtaatcttaataatgtcctcgggtgttgatagcacccgagtgagtggataaaacggtctgggagctaaccgtccactgacgctgaaaaagcacttagctgacgatgagggcttatcacccaaacgagcacccgtcctctgctcacctattctaagtccccttagttcagtggatagaacaacggtcttctaaaccgtaggtcactggttcgaatccagtaggggataccacttcttaaaggccctttagctcagtggttagagcaggcgactcataatcgcttggtcgctggttcaagtccggcaagggccaccatatgaagtcgggtcgctcccgataagtcgtcgaactgatgttccctgactacgagttccctcaacgataacgacgtagatcacagcagaaacggcgcaccctatttcatttcttaatacatttcaataagttcttgacataatactattatactgctaatatagttatatcgactgaattgaggtgtttatggctaaagctgaaatcgttactcgaaaacgcggtcggcctactacagaggaaagcattgcaatcaatactgagagagcaattcttcatgctcgttccgagtttgcaagacttactcctcaagcaattaaaactctggaaggtctactgacttccggtacagagaaagttaaagaaactactgcgaagtatattcttgagcaagctgaaaaggcaaacaatctgtacacaatggaagataatgaagaggatctggcaggaggaactacttctgcaaattcagaaactcatcaaggcccttctgatgcatttaaagatgctatcccattaactactcagatccgtgagtataaaatggcagaaggtgaagattaaggctcgcaagggcctttactaagaagttctctttaaggtagttgcttggtgtaatttttcggctgatggctgcaaccatcttaccgatacctcgtagttagtgctgcaaacactggctaccttaaagagaatttaactcgtcgaataaggaagatgctgatctcaaagtgaggtcacttaccgcaaggggtgtgcatagactcccgcttccgaatagactatgtggcgagatgtatttggggacgtggcagagcggtcgaatgcgcctgactgtaaattaggtatctcacacggtggttcgaatccatccggccccaccaaattttccgttaggcttataggataagattcccgcaacgtctcgttgtgatactggttcgaatccagtacggaaaccaaattaatgtgcgggtaacataattgtcacggtggcaagctggcctccaaaaccagtcgtaaggagttcgactcttcaccttcacgccaaatacggtgtatagcgcaacttggtagcgcgaatgctttgggagcattaggttcgaggttcaaatcctcgtacaccgaccaaatatgcgggtatagctcagttggtagagcttctgatttccaatcagaatgtcacgagttcgagtctcgttatccgctccaaacaaaaatggggattagccaagcggtaaggcattggattttgattccaacattcactggttcgagtccagtatccccagccaatttaccctcatataataacaataagataatctcctctccttcgcctcagcctccctcatttgggaggcttttttatttgtgatttcggtgataaaatatccaaaaggaggatttatatgttacccgctaaaaaatatttcatttacgcaatgatcggcgttgcgttatttacgtctggaaaactgtatctcggacacgtcgagtctgtgggatatgacaaaggctacgatgctgcaaacacggcttggataaagaaagctactgagtacaaaggaaagcttgactctacattggaagagaataagagattgaatgaagaactttcttatgcaaatgcaaaacggatcatcgctgaggaaaaattacgtgatgaagtagaggcaatgagaatcgactatgcaaaatctaaaaagggacaagaaatatttatggatgatgagatagttgatatctataacaaatcactgggggaataatgaagaagattatcgccggaattatcctttgttttggtcttgttggttgtcagagtaaagaaatttgtgggcctgctgaagaagttaagatagaaaagctgatcgaaaagccggatcttgaacttatgaagaaagaaggtcctaagctggttatggaaaaacgctctgcaaagacaactgttgctgacgttcttagtcataacaatcttcgtgctgcaagaatagaaagacgtgctgaaggattacagacctacgtttgtaatatttttaaagaaaatccaccagagttctgcaaataatgttgacaaggtcagtgcttttatgcattggcctttattttttgtcctttttatggtaatataccttttatcagttcaagtcaagaactaaaggagaatt

SEQ ID NO: 16 - DNA, 175178 bp, Unknown
  bacteriophage genomic DNA
  misc_feature (175009)..(175009): n is a, c, g, or t
gcacttttattgtcattgcgttgttctcgacgctggtcttttwtcacagttgctaataacatcttccattccagcgcttaggtttatcagaatggaagatgttattagcaactgtgatatcagaaactccatctggagctttgcgacgacctgcccagtattcacctttaggatttaaatctttacgacgaatagtcttacccattttaattccttatcaattaattttattgattggaggacattataccctgtcctcatgggtttttaaactagaaaattcttaagtggcgattaatcagccaaccaagatggtccgcttcgatttcagttatcttaataccgatttctttaaagcgattttggagcttcagtttgtcattacgcttaattaggaccactttaggaccataagcgagttcagcaatgtagccattttcaggagcagttgaccaaagtgtgatgaagactactttttgttcatcaacaatcaaacggataatgtttttgacttcagagattttaatagacattagttcagctccagtaaaatagcaagaacaacctgctcaacttcggtatttaacgtatctgaagctaaagcaaaaatgcagttagagatacggtgtgggttcagtttagcttgctgtacatggcattcagtacgacagctcagagcacggaagataatttccatattaccaatttcaacaacaagattgtagtgcccgtggcgatttgctacacggaattccatacgaactgatttagttttagaagtaagagtagccattttgtatctccatttgttggtgtaggaacatactaacacgaacaaatggagttgtaaacacctaatcttctatgatgtcagggtcaaagcccttttcgaggaggagttgtttgaagagacggatattatggacgagtttgtcgtctacaaatatcacaggatagcgtatattgagcgtagggaaccctgctcgtttagctaatgaaacaataagaggtctgtcgtaagtgaaccctacgccgtcctgagatggcgagagcacatcataaaacgaaaatggaagacctaagccttccaaaatcttacgaacatgaatacaaccaggacaacggcttactgtctctggaatcccgtagacctcaatctttagtgattggttttccacgtgtaataccaccttcatatacccatgaaccgagttcttgatattcaccgtcttcatcttctttccatagactgatttcaataaggaaacctgtatcagcgaactggaagtagacagtaggaagaacacggtgttcaaaacttacttcgttaatttttgctaatgtttcttcttcaccgacaaagaaatctgggttcagtgtacaaccaccaaactggtagccgtcaccgatgtcgtcccattctttccaatcgattactacaaattcttcaaaacgtttcatttgtcagcctttttcatagcttctgctttagcttcaaccttagaaatagctttatcgatagaagctttgaagtcaaatttttcgccatcgattttagggtcaatataatgaatcagcgcagcaacaataacaacaggaatcatagcaaccattgcatatgccatcagaataacaaacagaattacaaccagatatttacggaactgagtcattagcccaccattttagttagagaatcaataagaagcattgtgtgtaatgcagggaattcttcacccattttcataatgagttcatatgcatcacagagttgagtattcagccaattcattttaacgatttcctcagttgttttttgaacgaagcgaccatcttagtttttgtatcgctttcgatataagtaaaaccatgttttttgaacatagctatcatatcatctttattgccacgagcaaattcttttgctttatcagtaacaaaattaggatgaatattgttttcgctataatcagttttcagatagacgagcaaattctcaagccattcgaggtagtcgacattttgacctttaagaccagagcggttgaacttatgcttcatttgtccttctgcagcgttacacaaattgcatagcaacccacgaaccttaccggcttttggtccgtttaggtcgtggtcgtggtcaagatggttagcttgaacatcagagtctaaatctctcttacagattaaacacttgccatgttgtgcatcataaaatttttgtttttgttctttgtatagtcttccagtcaaaagcataagttcaccccataagtagatgaacttatttatgcttagaaagccctgtcagaaaattcaagttgtttttcaagttgatgaatataatcagctgctgcctgcataagatttgcttcataaccgtttacacgagatttagcttcttcaagacgaacagtaatttccataccatcgaattggttcataggaatttctgggaacatatcagaagcattctcttcgatttctttgagctggtccattgtgtcttcacaatagaagcaccagaaccaagagtcacgtccattcacatgaagataaggaccatccttgattttgaccgaagtgataccatcttcatagtcacggtcacgttcagcaacagtaacaaccttgaacacaacacccttcttcaattcagggaactgcatttgcagttcttcatcatcagagatgatttcaaatactttaccgattaatctcattatcttcttctcacaggtttatcatgaatagcacagtggatagcacccactagtataatagcagcaatacttatagcgattgcaagttccatgtttcctccaggtcgagcagttcgttcactgtaggttcatcataacacggaacttcctctgtgtaaacaggttcttcaggctcgacagtttcccatcgagatgcataccatggcttactggtcacgccaatagcttgagacttcgaaatcaggagcatcatcatattcccagaaccattcgcctaccggaatataatcggtttggcctatttctttattctggaccggctcatagtcagtattctcgagaccaacgaactgccattggacttcataagcaacaccgccaataacaacggtattctcaccccattggttctctacagcccattctatgccttcagacttcgcaagttcaaccatatattcatacagtttcaactcgaggtcatcttgaacgccatcacccaaattaataatttgacctttcatttttcagttattccaattctagtagattaaaccactcagagaaaacatcatgttcttgttctctgagttcccagaacatcttctcaattttctttagacgttctaactcgtctattggaatttgagtccatccccaaggagatgaatgaaggttcatttcagttgtcctgctacagcacggaaatcatcgaaaccaccaagatggttatcgttccagaaaatctgaggcatagtgatacctaccttactttcacgaccaagacgtttcagaaggtcggcgataacagcgtcatcgaatacttctttctgaggcatcacattaacaaactcaaatggaatacctttcattgtcgccaggcgtttagcattatcgcaataagcacatttatggattgtgctgtcgtagccaaaaatcgttaacatcttcgtctatttccttaaaaatttgttcgagtacatcattaaaatcaggatgcatgtgaagcggatggctccaattagaataaccttgaatgccaagacgtttacgtgcttcatggtaaatcgcattagaggcaaagttcttggcttttgtcatagctgattttatcacagaatcacttggagcagaattattctctttgtgatacatcatgaataaacgcagagcacaacgctctgcttcttccatatattctttacgttgtttagccaatttcaatcacctttttatatgcttcatgggcagcaatagcgatacgttcagacatcggcagtgatgtttctggttgctgggctaactgagctgctgcattgattttaaacatgataatatcaaaatctgttgcggcatgaatagaacgatgaacgtggtccatattcaaagcttcgcctttttcttcagcgtattggagacaaattttagccgtaacaccacgaagctctttaaacagagctttcatttcaggggtattagaaatcttttctttattatcaaatggattcatcttacaccccagggaaaatggctttaacacgttcagcaatagcacggtctagaacttcagtgaacttcttgttcagacgatcaacaataagttgttccatacgggcttcagacatattcagagcattttcaatacgtccttcaaggtctttaatagccttttcaacctggtcgcttactgcacccatcacttgagaataggcaacacgatttgcttcttctttcatgacacgttctaattcaaaagtaccttcaactttattccagcctttagagacgaagaatttattcagctgctctttaaccatcggagttacatccggcaggcgcgcgcctacgagactgatttctttctgaatagtttcttgcactttgttcttactgttcttcaggacgagttcctggacaacgttattgataacggcttgttgcaattcaacacgtgactcttcgtcagaaaacagcttcattacagcatttgtatcaagttttaaattaatcattacgaggctccttaggagtaatcacaagtgttttatcgccaatagcactaattacatcagagataatattatcaggcattggctggacttcacaaatgcttttagcaaatgcctcaatatctaaagccgttcgagcttttacttcttttaatttttctaaatcaatcattttgcctttctctcaaatcgatgcttacatgaacggcatttataggctagagttggagtactccaactcaccaattgaacttgtactgtaccacacttttcacatactggcatatcttttgctgcggcttcacgccgatctgccatttcgagaacacgagcccattgaactgctttatgtacttcgccgatagagtcttcatcggtgataacaagttcttctaatgaaggaccttgaaaaaggtccacttcagtccagccttcaggtaaagataaatctaaatcttcagctaattgatttttcatttacgcagttcctgcattgcatgaagcagtttagcacgttgtgcacgaatcttatctgctttaccagtgagttcatcgatctgacgatcataatcatcaacaacaatagtcatttcattcacagacttttccatttctttatagaaatgctcttcgactgggactgattcaggcttgtagattttaaggaaatctactttagaagtatctacagatagttcgcctttaataacttcttttggttcgtcaaaatcaggagctttaacctgcggtgcacgaacagttaccgtgaatacaactgatgagccaaaacgacggaacgtataatggaacaattctgggttagtcgcattcatgaaagcacgaagctgcgcaaacgtcttttcttcaggggcatggttgacaattgtaacagtgaatttattatcatagcctgggatcattttagcgtcaagataaggcaatggctcaggtccagttttaaactcaagctcacggctactaccaacacacaagcgagaaccgagtgtcagaatcatacgccagttgtaattgaactctgaacagaaactttgagtataagctttcattgttggcgaacatgctgaggtgtaatgtccacgagcgttcttacgagtaaacttcattccttctttgcgttcaccaaactgagagatacgttttagtgctcgttcaacagagaaatatttactatcacgcaatgctttatagaagtcatatacgcacaaataattaaacgttggtgacagaggaggcagtcgattcatgatttcttgaataccaacatgtttaagcgcattgatatcaagagataatgccatctgacgaataaaaggtccgatatcatcaggatgattctttatcaccatagatgaatcagtgaaatcatttttataatgattagacggatgacggaaatggtttgccgctacacggcacgcttcgcgtactacaattctgttattcattttcaattcttttgctactgacataatattttcctctatctttattggctgataaataatcccgttttgaaaggaccatgattcattataccatagccctttctaaagcgttttagtcgaaaatcatttcacaaatccaaacgaatggactgatcaagactttaaggatataaaatatccagaacacaggccacataacaacaaccattgcggccgtgtttccatcaaaatcatctaagaaccaatcgccaacccaacggaaatagaaggctgatgcaaagcctacaataacgtaggctactgcgaataaaataacttccattaggacctcgaatcaataattcgtaattgggtttgtttgtaggtataaattgcttctttaagttgcgagttgctcactttaagattagtgttataccatttattcaggtcttgatgctttttgtaaacttcttgaagcttgttattggcttcaattaaagcatcttggagcttattaaactgggtttccatgacttcacgtttaacgcttccatcatagttcagagcacaaagaacattagtatggcgccagagctctctgagttcgcctagaacgtttttatctttaccccaattaaacttatacagttcttcacaaatggcttcagcctgcttctcagctttacctttagccatcccagcatagatgtgagcaggtggataaagggccgtgttatcgacccagtttgaaagaataaacattaaatcaccactgaagaaggacgtttaaagaaagaatgagtaatgtcattcactgcttgcgtaaacgtagctttaaattcaatatcaccacggtagtcatttggtacacatttaggaagtgaaccataaaccgtagcaccattttctagtcgaacagtcatcttagcgaccgggccataaatatccatccactctttgactgaaacaaccttaccttttactgtctgtttgcccacaggagcttcgcctttagacttattcagctcagcgtaataattactgtaccaagcttcgctgtacgcctgaatcgcttccaggatggttttatgtgcacgtactttacacataccagccttatgaccaccttccaagtcccatactttatatggagtctggatttctactttatctaaagctttgatttctttgtacatgtcataagtaagacgaagcttccaccaaccgtggtcaccagtgtactcaggtttgtcaaagttatcaagctcggtgacatatggaagataactaccagcgtgatatgcttccacttcacctaattcattttcccaaaagtaaccatcaaatggcgcatgtggacggtcatcaacaccccaagtaggagctacgactttatcgaatgattcacgtccgtagagggacttgctccagcctgagttcaactcctcggcgcgtttttcaactttcgctcggtgctcaagatgggctttacgattttcttcaaaaaggtcgttgatgattttagttaacatttttgtatctccgtgttggtgtaggaacatactaacacgctcctacacctttgtaaactacttgttcacgcaatagaaaatccatacaggccacgcaagaatgcaaaccaatgttttgaatgcattacttctacgaagtttgatgcctgtgatagagatgcacccggcaccgacagcaaaccatgatacagcaccaatgatgttggccaaaagtacaggttccatcagtaataggtcctttcatcatattcaccaccgaaccaagcactcacaggcgctttaggttgagtagcttttttgtaatcgagatgagccaggtttttagcaatctggtaaccacgagttgcattaatctgttcatggtccatagtaattaaggactttgcttttgcaaccagaatcacacgcttacgtaagcctggcatcgtaatagggtacatacgaatctgatggaaagccacgttcatgaactgaatatgcttagctacagcacgttccatagctttcttgaagtcttgagaggcattaaacagtgcccattctaaactattaatcggagtcatttaatcacccattaagtcattgatatcggaacgatagatatttgcttcggcaacttcttcaccatcaagagaggctttaatagaaagtgtaccaaacaaactatcgtagttaacactcagctcaagttcttcacggataacgcgtttcacctcaagccgaatcatttctttaatctgttctgaagtaatcattggtcttcaccattgtagatttcttcttcagtgtagaccgtatgtttacgttccatgacgtaatcatacgggtcatcaatgtccatacgctgccagaagcaacctaactggatatttttaggagaattagtaggacttccagtgcaacgtccacggtcgcgacgagagtaacgatgaacaccgttttcatccatgatggtttcataattagtacgtttaagaagatcgaggtctttgaacttaaccatagtgactttatcaccacttaaggtttcatacgtacaaccttcttcgaaatatttactttgtccaccattgaccattacaataacatcttcaacgttttggtcagggaaagctacaccattagtttgaccatgctgaaatactgcctggaattcgttttcagctgaaatagtagccttacggaatttgccatcccaaacgccatcaacaaaacgtttgaatttgatttcataagtccagagtttcattatgccacctgaagtttagagttgattttagaaccaatgaacactacaccagctacagctgcaccacacactaggccacccgtaaacaggtctataatagcttgttgacggtcaagaacccaagtcattttagcaatcatttcatgtcgcagagccagttcagaattaccaatcagagcatagaacagtgaagcaatatagttagtgaacattttattttcctcaaatcagatgaacagtattatcacgtttgtagatgtcgataagcatttggcttggctcttcataagtgaatcgctcatacgctttaatgactgttaaagcaattgttgccattaacgcaactttaataatttcagagaatacttcttttaagaatttcattaaaagagccaagtcccatttttatcaatgtaatctatccaatcgttgatactccatttagtagtatcaccttttggtgtttttacttcgtaaagaccttgtttaaaaagcatctttttaatattcatatttccaccatgatagttgataggaagactataccatgccttcctatcgttgtaaacacttacttcagaagagtaacttcagcaatctcttcccaaccatttgcatcagtagcgacgaagtcagccaggtaaagcgcagtacgtaaggacacgttacggagcttagatacattagccttcatccagttgagcgccatggacgtctgagcgtcgcttaaaccacgtttctgcatcatgttggtgttcagaattacatcttcaacacgaaccatgatttcttcgtttgagtgaacacccagatccagataaactgaacgtgatacaagagcatgaaggtgtggagcaagtttagaaccacgttctaattctttatcgatatcaacgttagtgatgaacacgatagtaccttcgaactcgaattctttatcgatgtttttgtcatcgagataagcagaagcagtgctccaacaaactttacgagtttcgccagtgtcgagtgctgctttcaggaggttaagcatatccatatcagagaatacgtcaacatcatcaataagcagaacgctatttgcatcacggttgttccaaagttgttcataaagaccaatacctgagattttaccgttgatgcttttataaacaatttcaccatattcgtgagcggttttcaaagctttatcaaggctgtaagttttaccaatacctgcagcaccagagatgattaatgaacgaatgttaccagagatgatgcctttggtcatcatgttcattactgtgaagcgcttgttgatacgctgtttcatttcctcggctgactcaactgtggccagtggagaaacctccataccttccatttcgatgtctgatttgaatacccaaatcccacgttctttaccatcaaccattacgaacactttaccatcaccaaggtgtgcttcatgagctgggactacatctgggaaccaggtctttgtagcgacatacttaccagagaagtcgttaccgcggaaagtacctttgttgatttgaacgttgaacattttattactccgtgaatttcagtatttgtttcgatgcagctataataacatgttcgctgtagatgtaaacacttttgtgaaaataaatgcccgaaagggcccgaaggcccttaacttattgtttattaatctgattttctgcgattcgttttggtaatttagcaagccatgctaatgctgaccataatccaccaacacagaatgcaggcaaccaaagaacaaaccagaaccaccaatcgacagccgaatgaatatgttcgtttttaatgaaggccttggtaatcaagaacccaatggtaaagtacactcctacaagaaaaataggcataaaccaccatagttgtgctaaaagaattgccgtcatatttgactccaataaagactaaaaacggagttcgcttaacgcccatctcttaaactttctgaattgtttaggagtaggacgacaagcatacttactatttacacgctttccggtttcacgacaaaccgcttcgagataccatctacgtcctttatgtggtctcccgtaggagaccatgaattttgcatcaacggtaatatgaattgtggtttgcaagataaacctcttcaaggaacttgttccagaagctcatatcaacttctttacgcattccattcttttcagcgtgagctgctaaaagttcgacatggtcaacggtatcttccagaagttcttggacatacttgaacttgaacataccagctttaatcattcgaatcgtttcggcttcacgcagcgggaataccaaatcgccggtttgataaatttcacgtaactgaataccggcgcgatatgcatggctcagagctttccagtcaacgccttcattagcttctgccttacgagcacgttcgccatattctgcttcaagcttagtcaagctgtacttgatttcagcaatagtgattgtgtcctggaatttacggccaagaacattatagaaatgctgcttacccattttagagtcaacgaattcagtccagaacaagaactcacttgtcggcagaagatgggcaatttcaccaagcttccaacgttggttatgggccttatctttagggcgatcttcatatttccattcaggataatcgttcagaatattcagaatgattttcaggtctgccagacgagaacccttgacaccatatttcgctgcttgcttacggacataacccagataagatttcatatctgtggtatagaagcgttcacggttatcttggataaacttccagacatcaggcagatcagatttaacaattaaatcagcaggagtatgaagcatatcaagagcaacagtttctcctgactgagcgagttccagccaatatttgagagaatagagttcatggtcaacatcattatgtccattcttagaagcagtgttattggtgttcatgttagtatgattcattgcacgacccataagaatatctttagggtgtggaacgaagatttctttgaaatcagtgtcactttcaggcgttgacgtgccatataaatggctaccgaagtagcctttcataattgtcttcatcgtgtaggattaccccattcaaatccagagaatgcatcgataagagatttatcgttcaggttaaccattaaggctttaccatgatcactttcaaggaacatattaccaccatctttagtgatagcaagaactttaaagaaatgacctgctttaccaaatacatcgccaactacgaccgggatcataactttagatttttcactgtgataatgagtaatcttatcaccggcaaaagaaacttgttcttgaacgccttgagacatcacagtgactttacttactttataaactctgattgaacccgtggtatatgcaaccaactcaatcaaagtacggtttgaatataccttcaataacagcctggtatcacgcccaccatcaataaagatagttgctgcaccctggaattcagagataaagtcaacaataccatcaatacattgaccattatccagatggatttctaaagaacggcctgtttccaggcatttctgacgacgaccttcaacaatactaggtttaacgaacatggcttattccttatcttcaggagcagtgaagttcagagtagggcagatttggtcatgcttagctttaacaaaagcccatacgatattttcaggttttggttcgataccttgttctttcagacgttcgcgttctaattctttgtcgtatttacgatcagaccaccagtcttgaatacgctgaacacaccatacaccgccaaatacaacagcacaggcaccgccaagaataagagttaacataacaatagaagcaaagaagcttgcgacataagcccaaatgccggcaataccaagaccaatcatcgggtcaaccaacagattactgagcgttaaagtcaatccagtaccggtcacaccaaagaacataatacgatacaatacggcacgcatataaggacaaagtgaacgaggaacacccttagaagtagtgaaggtgtttttaacaagtttgtagtgccaagagtttacgttaatattcattatatttcctttcaaattcaagattagagaattggtgtaatttgtactaagtaatcacgcaaagcaataatatcatttttatctaaagcaataatatcgctgtcctgtttgatggtcataatggtgtcaccaaacccaggctcgttggtctttttaaccttcaggaagatatcctgaacgtcatcatcgttgtggatagtcgctgcgtaacctacgccttcgtaattcagtccaactttcatttcaatttacctttagcttttgcatcatggattgcagcaagaacacctgcatagttctcttggtcacttttacgtacgatagtcatactataaggcatgctatcaccatctttaataaaacgttctaactgacaagtcagaagaatttcagggtgaaacagagtatacatcagattacctgtagcgccacgatattggcaaacttctactgactgttcacctgtataagtacgagtcagaaccaggtcgcctacttcaagctttggaaaactcattttaatttcctcatgttgtctgtaggagcatcataacatgtcctacagacgttgtaaacacttagcggttatgcttcagaatttcatataaagcttcgacttgttctgggtctaaagcaatagtatcttcgccttgatgcataataatgccgccaggtacggttttccattcatccacttctacatcgagtgaattgttgccagcaataggattttctggcttcagaacaatcacaccatcttcagaactaccatatgggtcgtacaaactcatcgcatgctcctatgccaacagttacgtggctctcgtttaaaaatgctatcattcatagcttgacatttgatgcagtacatgcatccttttgccgccagacgacgagcttcaggaataggttcgtcgcactcgtaacagaactcaaaactttcatggtgttcattaatctggcttcgagcatgaactactgcagcctgtacgactgcagcgatttcatcttgttcagcaccgtctttagcaaatccaacagccatcagagcttctccggttcgttagtgtaggaacatcttaacacgtttgaaagagtttgtaaacaccttcttttaaatgcccgaaagggaccagaaggtcccttatttcaatgaaagcaaatacttggtttggtaacaaactccgacgatatcgtcaagaacactatgaagtgctctaggagttttatcgtaaataggctctgcgcatttaatcatttcgtcaatgaacttaatagtatctttaggcatttgtgatgcactcggtaaagaagcaatatatggtttaccggagaagcctaaatattgttcactgaatttatcgattaggggttgtatttcagcataatagaaatcgtaagctttatgcctggcataactatctgtttcaagatgtgccgatttaacataagcagtagaagccaataaccaacctatgaattggtctacttcagttccttttccttttacgaaatcattgaatttcattgtctagtttaaccttatgcgtatatgcatacgcttttgctgcagagcgtccgtcgatttcgcaaactcctgataaacaaacttcattattagctttccatcgggaattaacaaagctcaagaatttattggattcttttacgctgggttccttaaattgcttatagacagttaaagccccctcgacgaattttgtatattcggcttcatttgatgttgcagaagcgactggggccataaagaccccgattagtgtgagtggaaaacaaatctttttaaggtggtccataagtggactcctatcgatttaaaatatttttctttgctgtcaggacagccttaacttgtttgaggtatttttccagtaaacgttggtgagtataatcagctttgaacccgttttctttgaaatcttgtttagaggcaccaatcatagtacctaattcacgacggatttcatctaaagattcaatagacagattacgtaattgcttttcagacaaatactgcatatacacctctttagttagttatatgtatttattaaagtacacatgtactctaaattttactttagtcccacatcatagaggaaacacctttctcgtatttacgagcggccttttcgtcccagttgtaatcagtatcgcttctcagcgagtgtttgatttccatcttgtgaaacacacgaggaattggtgatgcatagcgcttccaacgaagagttttccagaacgagtcacgatgacgctcagccatcagtttagacaagcgttttggctcttccatattttcagcaatatcgcgttcgatataagcttcgttacgtgctttattatcgctttggtgtttctttacataagcaaatggattgttcttttgtgcatgccatttagctgaagtggttacgtgccagcctgcacgacggatagttcttgacataagtacctcgaatagtagttaaactgcatattcgatagtaaaagcctgatttaaagaatttcatcctaaagtcaccttacatttgcattttgggcattcggcttctttaacacgaagccgtttagttttggtctttggtgcagtgtcatgatcgtaaacatgaagacaccgataacaaattacttgtttcatacacccaccagttcgcaccaatgttttctgcacagtgagatataacgatcctcaccacctaattcaacctgagcaccttctgttatcgcggacccatcttctctgactcgtgctaccattgtagctttacgtccacaatggcacacacctttgagttcgactaatttatcggctgctgcaagtaatgctttagaaccttcaaataactcaccacggaaatcagtacgaaggccataacacattacaggacaattatacaaatctacgattttgcataactggaaaacctgttcagattcaaggaactgggcttcatcgaccattacacaatgaatgtcgcgttggacatgagcccatttaaagaactcaagcaaatccatacctggggtaataatatttgcttcttgtttaaggccaatacgagatacaatttcagtagatgaatctcttgaatcaatcgaaggtttcattactaaagtgcccataccacgttctttatagttattagcatgcgaaagcaaggccagtgatttaccggcattcatacttgcataatgaaaataaagttgagccattataaatccttaagccataatgctttctaaatattgttcaagctgttcacgaagattgtcaacttcttgttcatcttcttctttacttgaacgagatgcagtccaattggattcagaccatgttgctgcagcctgagcaatacgcatctcatcagctagccagaagatatgttctttctgttctttagtaatcatattctataccatccatagcaagaatgtgtttacgttgcttttcaagagcagcttcagcttcttcaaaaagtttctgagggccttctaagcgttggtacattacttcttgagctaagttaataagcttatcaatttgctctacaatatagcactgttcttcatcagatatggtcatcagttaccgtcccaatctacaataatgatattcagattaggagtgaacatatcgattaagaccgataccttttcccaatcaccaccggctataccacaaccaatacgtggcatataaacgagtggaggaacaatcttattagaaccccactcatttaattctatcatacagtttactaaagcaccataatcaagatttgggcctggctcgtattgtgtataaaggttaaagcaatatacttcgttatcacctggcccatgaatcttagttgctttagtataagtaccaagcttataagagtcgccaagtaaagtatctgctttgtcgatagccagaataggaggataatattttgctagttgtcctgctactccagcacccatttgatggaaacagttacagccgtgagcaacgttatacccagacttgaacaattccacgatattaccggtgatgtatttggtaatcatttagcgtttaaacctctgttataagcgtcgaccaatcggtcaaccatagacgtacacacgtctttaaattgtgcatcggatggaatgcattctgttgtcattaatcggttttcatatctttcagataaagctttctctctgtatcgagagcgggcatccatctgtccgtctttatatgagctcataacctgattactgaattctaaaatacaatccacatttgttggtgaacaataatctttagccgtacgcttggcatactccaatatatctgtcatattagacttagttacttctatttcaggatttgctgatactcccatacttagtgttaaacataccgccaaagctatttgttttaacatttaatccaccgtttgatgtagcatccttttggatttaaggtaatttgccttagcaagaacctgcgatgcatacttattcccagcttttacattattgcctgcattgtaagaagcaatggctttcctcatatcaccattatgccgttctagccaataagataactcaatataagcccaggacgcactatttttgcgctccttaatcattttgattatctctttatctgacatcttccaacccacctgcgccatcctattacgtagggtgggcaagtaattttggaacatgccgtaagcatgatgcttatgcttttcttcacctgtatttaagcctgcagaactttcctgccaagccaaaccagccattatataacctaaaccgttattatcataacgcttcgatggttctttgaacttacccgacttttggaactgttcaccgaacgcgtaagcgtactgcaaattgtcaagttgttcattactgaaagtaggctctacgctatgggcagacatactaactgtcaatagtaaagttgctaatacttttttcatgaattctctcttagattaaatcaataacttttgtgctagtttttccttcaagacgacgattgttgatgaaagccatacgacagcacagagaaggcattttgcctggctgaggacggtctacggtcatacctaaccacagattgcggtcagtgatttcaagacgaagaggacggtaattgataccaggttctttgtcttcttcaacatcaggtaatgccggcatattaagaaattctacaacttctttaacatggttatgaagacgtttgaatagtgcaaagacgtactgctcatcaatttcacgttgaatagcacggtccaagaggtgagggctgtacttaacaaagaagcgttttacgcctgcttcagtacaggatgatgcaatagatttgttgatttcggcgaactctgtttcaaagatacgacgaagtttgttgcggcgaatgtaaacacttgaatcgatagtcatttttatctccttttagtgtgtatgaagatagtaacacaactaaaaggagatgtaaactgcttattcttggaacggggtgagctttccagcaatagaacaaatttcaattaaagcaggatagaactctttaacctgttcaagacgttgttgggcatacttgagttcaccttcttctatacaggctgcctggtcttctagaagatacttatgataaccagtacaggcatcactaataatgcgttgaaactcttctaaactttcaatcttcatcagtatttctcttcaggacggaaaaccgcgcgacatgcccacatacttgcttctttaagacgttctttagcaatattcaattgagccgcagcaataagatcttcattgatttgcccatgagtctggtcaactttagttgcaagtgcttcatcaagcaaggcatcgagaattaacccaagacggacttcggcgtctttgatagcgtttactttaccgattttgtcttcagtatgtggcttataacccttaatatcttcaatcgacataaggcacctcttcattagtttctttatcgtattcgactaagcgaataggttcatttacaccgtaaccactggtgctgatatatgtagtagcatcttcccacatcatagtttctttgttccaaacaccgttctggtgagcttccataaaatcttgctcaccttggttgctgaaccagctacaaaatgattctactaaatgtggggcgcattcgataacaattttcgccatgttggctccaaacaaataatcttacgatcgtaagtaataaggcttgaagttttaatgcctttacaagggccagaaataaactctacttcaaaccacgggtgctcattcatcagacgaaggtctggcgctgtgcaggtaaataatgagcctttaaaaggcccatctaaaaatcggtgtagccgaggtgtcaaatacggtttgcctgagatattaatatgagccagcttaatcaatgtctcagcgttgcatttacccgtgtcaataaagaaacggagccattcagaagcatttttaaaacccatataattcatcattgtattcccatcacaaagaaaagaggatatttaccatcacgcacggtaaggcttacatgatcttcatatgccttataaaatttgtagatttcaggcattttagagcacggttcatctattataaccaatacacgtttaagcattagcccacgataagcatttccgcctgaatcagataagaagctacgcattgcattagaaaatagctggtttggaccaatttcaatattacgatggtaacatttgattttaatacggtctgccgttgatttggcataagagctattataagccaaacagattactgagccaccttcttcaatccaatctgaggcaaataaagaagccgcttcagttttacctgtttgtcgacctgcatcaagacgaagagtgcaatattcttgcatattagaaatacgtgaaggttcgtatttttggttacttaaaacatcatcagcatgggcacgaaatgcatgcatcagggtcaagtatggagctgttaaatatttcatttttatttctcggattagtggggccattccttggcacataattcatccatgtcaccgcatgtaaaccccttaccgcgcacgggctcgaccttgttacaggtaggaaaaggtccatcactcagaggaacaatgttcatgaggagagggtcggcgtgcctttattagaaagaacctcggcctttgatcgtattctgacgacctttattttctaattcagaatggtcgatttcatacgcttgggcgacaccaaaagcctttttaactttagctaaagagcctttagatgtaacaatattaaaagtattgcctttagtaaaatcaaccaaatccacttgtacgccttgtttgccaaggcttgctacaatagcatcaacatattgctggtccaaagtaccctgaacaccaatttggaatgccttaggtgctttagcttcagaaataaactcttgataagttttcatttttaatccttatgcaaatgggtcgtgaagtttatttccaactttacggaagactttagcagcaaatttattagttgggttatcaaccataattttacgcatctggcttgtagctgcagtacgagctgctttataaccagcgatattatctttgatagttacacgtttgccaccaggaccatcaacggtgactttatatacgccttcatcttcacctggctttatttcttcaatccagatatagccaccctggacacgttgggtctgggctgtttcagtgagaaactcttgataagttttcatttttatccttaattagttgtagatagccttaccataatgtttataccactgaggccgttgagcaattttttcatccagacgtgcttgagaaattttaagagcgtctggagttggaacataatcattgcgaaattcagctggaatgtcgctaatatcctgaacagtagtgtcctggattttaaaaccacgttttaagcattccgcaattaagtcgatttgacgtttacgcaagaactcgagcttgtcataaaagaatgttacatgaccagtacctaaaatgaaaactgaagagattttaaaatccttgagctttttgccgttttgaacgtgtttacgaacggcaccgaatacacgaggtaattcacgatactcggccatcaggtgttggtcagccaattcagatactaaagtaaggttgatacgagtcatttttaatctcctgtagatgataggtctatagtatcatgtctacaggagatgtaaacaactttttatcaagtattcgctttattaattaccgcgggctgcattagcaacggcgtaagcgtactgaatattagcgtctttaaacgtacctttagaggtatctagttctgccttaaagccacctttagtcataacatcggcaaattctttacggaaagccattgtatcaagacctttccatgttgatttgtgcttggcaaattcaagaccagcgaagttgacagccttagccaatttattatcaataacccatttacctgctttaggtacaaataccgggcctttctgtttagagaatagttttaaattccagcgacgaaggtcaccgtcagctttaacaaaagctgcgtccaagttactagcaacaacatcctgaatatgggcaaatttaagtccatcagcttcaatatttaggtcgtttcgccagcgaagtccttcccaggcgaaagctttaaagtcagaagcttttgtagctaagtaccgttcaataggagctgttttagcgtcaaaaccgtttccacggtgggtccactcatctttattaataccgctgacctttcctgcagaagattcggcaataaattctttatacgttttcatatgggtcctttaaaagtaaatattttaatttgtctgttcaagtaactatagatatactatcacaattctaggagatgtaaacttatttgtaggtcttcatccaattcttaaacagagcggcaacatctttctctttaacgttcagtttaacgtccaacattttaccacccgcctctctcgtttggcgaatcttagcagtaccggtttcaccattccactcaacataatactggccagtgttcattgcaataccgtcgccaaagtcttcatttttagaagtggtgaatgtcagcttcatagtcttagatacacgagcctgcatgcctgactgaagggcattacgaacgcgaataacctgaggagtggcctgggtcaggttctcattcagttcttcagtgaactcttcagattcaaacatcgctagaagttctttagatgtaggaattacattctctgtgataaattcattataagttttcatatgctttccaagtacctgttttaaatgtcgaaatcacgcgcttagcacgatttggagtttgtttataccaacgagaatcagcaagctcaactgcggcctggtcccactgtttcgcttttaacagacgcatacctttagggaaacctgctgtaccagcaacacccatctggaacaccatgttaattaacgcacaacggcgaacttcatctagcacatcataaacaggttttagagtagcattacccaggatacctttacgagctttttctacagaagaattgaaaagattttctgcttcttgttgtgtgatacgaccattacaaacccgacccattaatcgatcaagctcatcacgtgctacattgtatgaagggtttttagtaatcaattgcccaatgccaatagtccaaaaaccttcagtgtctttgtataattctaatttacagccttcgtcaatacgaagcataccaaaaatgtccataggacctcctatctaattgatagaagtatttatcaacctacagacttgctttcttttgggaacaagcgttgcattacattgaacagacttggacccattacataattccacatgctaggtttaatcagagcaaaacggtcaatctctggaaaacgttcacctgtttcagggtcttcatgatatgccgtacagatgcaatccttgaactgctcgtgacggacagggagcggataaaggaatacatgcaaatctttattactagcatacttatgacgccctaggtccaccaggagtgatgcatcataatcaatgaagcctgtttcttcccaacattcacgaattgcagcacgaagaggagtttcatccttttcaatatgtcctttagggatgtcccaacgagaaggcattcctgcaccaagccctgaattagttacgcgtcccatgaaaagttctttatctttggtaaagaacaaaatcccagccgagacttctttcttaattacggtcattgcggcatcctttaataaatttatcgaattctttttgtttagcttcttttttctcacgttttctgaggaatggataatgaatcccataagctataataccggtaagaagagctaaagcaccaccaaccagaacagagaaaattgtccatggtaaaatacaagctaacgaaataaaaatggcggcacctatagggaggcctttggccattaagattggccataataagaaatacaccatcggtaaatacccaagccaacctaacgaatacattcctatgtcgacattgcgatctactttatcataccaatattctttttcagcttcagttttcttttcaggataagacacattaggctgataccccatacaaaactcctcaattaaagctctttttaaaccagacgggcaatgagaccaatctacattatggattagaaaacctcgatgacaatcatcgaggtttcgccaattaatacaagctatcattaccagccttccatagggaactcaagataaacctgagcgttcactctgatttcgttggtaatctttttgactcggtctgtgttacgggagactcgaccgaaccagcgccaaccatttttaacagccttagaaccagtgtgccaggtagcgtggtcgaattgaagtaatgtacggtctggagcttcccattgcttaaggttaccgtcttcgatgtgacgtaagacttccggatgccagtgcttgtaaatagttttgccttcaggcacttcagaaaacgtagcacgtcctgtcgcaaaatgagtaggacacacatcagcgttaacgagcccaataatatgttcagaaaggtaacgagggttatcataatcaggttgacctgcagttaagaaatgctgacctgccggaatatcaggacgtggaacatcgtcatggtggtagccagggatagcagggtaccagccaggcatcagcatatggatacgagtatcaattacaacttggtcgttattccaatcatcaggcagattcatgatgaagctacgagtgataggaccaccattatcaaaagcgaaagctaaatcacagttgaagaacatcgtttcgttcttgatttggtcattagagatgcgaccagcaaaaccacctacaaaacgagcttgtgaatcaaaagtttttggaccgttcataatattttcctcattaaaggaggacatcttatcatgtcctcactctgttgtaaactacactaacttatgaccaccggttactttcttgatttcacctgcaaagcctaatgcaatttcacgttctctgttcttagcattctgcagattttctttagcatatttacgagtgttccaccactttttgataaaaccgtttgtagctatttcacctgtacgggtgttcatgcggtttgttcgtactaaatgaacatagcgtgaatatcgggtccaaaaatatatttgttggataaaagctgtaatccaagtaaagaaccagacttgcatgcttccctggaaccaaggaccaaaaatagaaagtccccaatacgtgaatgttgccataataccagaacatgcaaaactaattaagataatagcaaagaacttttccgttttccaagtccaatcagagttttctcgccataagtatagttgtttgataatcattttcagtccttcttaaatggcagaatcatgtgctggtttttcttgaagcgttcgatgtaatcattcacaccaagcgttttatacatatggactactttatggtagttttcccaagcgtattcacggaaccaaccactcgtaattgacgtacagaccttctctaaggccatcatgaagctgtgctcagcagatacattctggaagttattaggaacctgagaacgttccagggctaacacacaagtctcttcgtagacacctgccagtttaatggcttcaggcagcgcttcgaacttttcacgactggtcattacttcagaaccgtctttcatatagaaagtatatgcaggacgatctgccagagctacggcacggtggatgctatcatggtccagagtatagatggtatcgttaaagaacgtatttttgcttacatccagtttaggatgattatagctcaacgtttctttctggcgaagaagcatgatttcttctagcttagcatcgagtttgatgcctttgttacgaaggaagcgaatgtgctgcattgttttacggaagaacggattgttcttcttgaaacgatggctcatcttaatcgccagacacatttctggagtagcccaataaagctgagaaatattatctttttttaaaaatgtttgagcatattcagctagcataatattagagcctgatttatctgtccagtcgaaaagatatgcttcaaaatatgtttcgcggccattatgatgacatttaaaagcacgaacgttaggagtattaacttctacttcagcgcccatcatacgacatttgaaatcttgccacgcattagttgaggcaataaagtcccagtcagaatttttgatatcgtcatagccaatcaaaccatggtgttcaagagcacgagaaccgataactaataacataatattttcctcttaaggttatcccagtagggtcactataacatgaccctatatgtttgtaaactgctagatttcgtagcaataagtattgtgggtttcgatgtagtcttcaagtgaagaacatactaatgggtccgtagtaccgcagacatcttcattgtaagggtcgatgccacaatgagcatcttcgaaacgaaccccgtagtctgattttttgtagctgatgccgaagatttgtttaaacttcttacgagagattttgtagcactctccgtcgccattaggatgatacatcataacatttacctcaacactgataagatgatgactgccaaccattgataatcatggagttgccatcaacttgaatagcttcaccaaggtctaacccagaacgatcatcaaaataaatatggaccatttcgcgctcgtcggaggcaacttggaacaggttttcaagagcagctttagccgtacgtactgcacaatctaattcacgagacattttgattccttctgcattgtttgataaacttatcgagttcgatagatttaagagttttgtctgttatggtatttacatatcgccaagtgtctgctgtagggtcccagaccatatcagggaagtcccaaggtgattcgcggaagtcattatattcattcactattcgagtcaattcaggcgtagcgtagattgtccctggaaaataggctagagatatatggacataacttccatcttcaaagtctatctcaagataacaattgactattcttagtttgtaaaattccataacacctcctaaacaagtacgggtatcttatcactaagacacccgtttgtaaactgcttagcaccggctcatagaagaactataccagaagccttggtcatgtggtagataatggtcttcacggacccatctgtagtcttcccattcatcagaagatgcaggaatgtattgttcgttgccggcccagaagtgctcacctgtggcttcagcaatttcttcgcctttagaaataagggcagaaatacctttagcgatatcgtcaacggtgtttacgtcaaattcaaatttcatttttatttccttagcaagaagaaggttgccagatagagccatcggcttcaacgttaaattcacgaccaacttcttcaccgtagcaagaagagttgttccagtcattaaaacgcatgctaccatcggaggtatcaaattcgaaaccgaaagaatcggctgcggcgagttcacttactttgttgaacaggatagccagttctttagctgcttgttcgagttcaatattaccagatacagacataatgtttccttagcattccatagaagatgatacccagccacctgattcgaggctggtataatacgagtgttggttgacggtggcccaattaggattgccttgttcagtataatgctcaagttcctttttcaagaatccaggagaataatacgttccacccataccataagcaggggcgatttcaaaactcaggtcgtatttgtcagcgactttctttgcttgattaatagcttcagaaatggccgcttcagcagcagccatcgccagttcaggtttatgtttagacattagcacatctcactcgaagaaatccagacaccttctgtaagattaccgttttcgtctagtccatagtccatagtacgacaagcgtattcaatatagttatcttcagcattagtgcctttaggataataggtttcaccattaccgtaatcaccacggctcatagaaataccgtattggtccatcaattgttctgcacgagcttcatctacaggttccagaagagcttcaattgctttacgagcagaggcagcatcggtaatcagagggatacgagtttcaacaatttcaaaggcttggtttttcagtttcttactcattttcttctcacatttttaataaaaagttcagttgatttacgctcgttgattaaatcacgggcatctttttctgcattgtattctttattgtatttcttccatggaagatattctttaaagaaataaagcacgcgttcgctttgataagtccaataccaagttaatggaaacccacaaatcaaatattttgctgtttctactacccagggcgccatattatctttcatgcttttatcaaatataattatatctgcaagacaagtgacaagcataattgttgcagatactaagccagcaattaaaaatgaaccaaaccaatctaagttacgacgaaatgtaggcttcattctatagtacatcataggctccttttctagctttaatattagcacggcattggtctacaaaatctaagacaataacagaacgatcttgattacgtcctttagtcttatggaaatattcgtcgattttagggaaccaatattccttcaaggatttaatcttatcactggtataagaaagcctaccaatggttgtatcacctgtagtaatgataacgccaaacttggttttgttgaattcaagggcaatatagtatgtgttatcactacgattattaaaagcagaaacagaccttttaagagactgccaattacgctcgtcattgttaaaggcaaaaattgaatattctaacgagtagatatcaataattttaagttgcccatgcccatctacttctttaaagaacttaatgatgttgttcatatcattaagaacaaatgctggggcgagacctgctttaaaatcagtagaaccaatagaagaccttgacggagcccagtcgctattagttatttttgggctagggtactttgcagcaattttaataatatccattggtaaacgagtattaacagcaaaactcttaatcatatctcgttgattgggttttaaatgacgagttacagcaatcaattcatctgtgtaatcggcactattagcacctgatttaggcgaaatatcaggcccacaaccttcgtaaaaactcataatattttcctcaagatggttaatcttaattatcccagtaagagggccgaagccctctttatattatttcagacttgccagatattcttcaacatcagcttcagtcgttacagtgccaggttcagcagtgtggaaggtgtcaactttcatcagagtatcgtcgacggcaactttagccagtgcagcgatttcagttacatcttcagcagttgcaacaccaagagcagcagcgctacgagtttcacggatgaattcgagcttaacagccaggtcctgtcgagcatcatccagctcaactaccttctgttcgatttcttgacgcatacctacatattcgtcggctttcttaagcagagcttcagcagtacgacgatacagaagaccaagcttagcatgggtgcctacaggctgaccatttgccaggagacgcttgatttctttttctttgctttcagccaaagtagttttatctgcagccagagcacggatgcgtttttcttcgttgatagatttcacatggctggtacgcagcatagtgattttatcaatcagaaggttagccgcttcggtgtactggtcttcgacagtagtgttacgagcaacgaaagaacctagtttagcacggatgaattcaaccagttttttcagaatagccattgtatttttcctttcatgtgattaagaattaaattatatcccggtagtgtaggagcatactaacacaactcctacacgttgtaaactacttataagtttcgataatttcttccataaaatcaagtacaatattatcaatcacagagtgttcgtcttcgccatgagtttgcatagcagacagaataatattttccattgcacgtaaagctgacagacgttcttcacctgacgggaagttaggtgtctggccaaacaggcgactaaaagaactgaaatatgcttgtgcagcagctttagctttatcaggatagtgcattatgttttcctctcatttgtctgtaggagcatcataacacgtcctacagactttgtaaacactctatttgtaccattcttctttcatagctttaagggcttcaatatctgtttctctatcataacgatattctttcatgcgacgtaagcccatgatgtcgctaccgaaattagaagaaatctcttcaagcacatggtcgaacgaatgatatagccgcccagatggtttgttgttagccctgaatttaacaaatttgtaaaatccagtatcagggtctttatagaagcaaaacgtgcagaaacgtaaagcttcaaggcttacagccctaataagaaaatcctgttccgagaaagcaatacctttagaaggcttggcaaagaacagtaaagaaccagcaccaaaataaatcatgttttactcgcttagtttttctgacggcagattcgacgggcttcttcttcggccaggtcaatgatactacgcagaacaggagttttctgataaagagaatcgacacggagaactacatacttagtgtccccatcatcatgccaaccccaagacttttcaccgtgagaacctttgattacggccgatacttctaccgaacaaccattattgccaatcttagtttcgacggtccagattccacgggcgatcgcggctgacttctgacgagcttcttctgcggcgatagcggcccaatccattttctggaactttgtcatgaacgtatcctggaattccagagcagctttttgctgttcaggggtcaaagattcaaaaatcttttgcatttcaggggttaattcaacttcctcgctgttttccatggacaaaggctcagacagttccatgagctcatctacagtcagacattcggtgtcatcagtgatagcaaaacgtttttgataccatggataatctaagcagttatgagactgggctgtcagcggactgatacgaatcagttgctgaccattatgcagaacaaagctttcacctactaccacatctttaaaaagtttcatattagtatcctttgccgaagaaataatcagtcagagccagttcaatcgattcgtcgagaaatacaagttcatcatcagcatcaagcatatcaggtgtatcttcaagagcagcttcaccatcacgaagaccttgaagtgctgcagcccaggcagcttcataatcaccgtcggcctgacgagcaatcagatttgcatgtgtcataatccaagaggctggccagtgcatagttttgtcatcgaagattttgaacgatgggcattcaaacatttcagcaggatattccatcgaaataagattacgtcgcattttgtatctccagtttgtttgtgtaggagtatagtaacatggccttttgtggatgtaaacacctagatgccaaaaagccctagaaaattttctagggcttaagattagatagtgtaggacaatcaggtttgctcagataccccgaaaggactcccatttctgagaaccctttcaagatcggcgctgtacgtagtcgcacctagaggtaccattcgccttacggtttcatttgcgatatccaccgtcattctttaaattgatttgtcatagggctcgaacctacacgcttaggtctgtcgcaccggcttccgccttactcacctgggtaccaaccagggtttcaaacaagctattccagtcgtgtctaccaaatttcaccacacaaatcataaattgtacggaacgccggggcatgcacccggttataaagcagttgacgctactctatatttttaagaggcgagcatctcgaccatatccgaacgtttcgtcaaaaacgctactcggcttacggcaaagatgggtcctcgaaccgtttatttggaggcgggtgatggactcgaaccatcgcatatcgggatatgaacccgaccttctaccaactgaatgtaacccgcatttgtccgggtccagagagtacaaacaagtagcttgatgtagaacacgctaaagatataatcttccgaatatagagcttatcccgtgggaacaaaccgcttcgtcctcggcattatcttacaggactcaaactcatctctctggactgcctcgtattgttgcgcccatcttgctgtggcattagaccatgaagcattatcggaatcgcctgattacgttaatgtctgggtgctatccagggaacagagcttggacggctttccatatcgtcatatggatttctattggggtgacctatgagacttgaacccatgactacaagaatcacaatcttgaattctaccaactgaattaaggccaaatcaatgtccactcgtaaatgaacattaatttggctagggtatcaggactcgaacctgagcatcgtggaatcaaaatccactgccttaccaacttggctatatcctatttaactggcggttagtgcaggtatcgaacctgccttgtcctaagacacagattaacagtccgtcgcttcccctctcagccaactaaccggaatttggtgggtctggatggactcgaaccatcgacgcccgcattaaaagtgcggtgctctaccaactaagctacaaaccctgtttattagtgaccagtactgattctctggcatatgtggggactatcggattattactccacattacataaggacgccataacttatttctaagtcgcaccgctccattcgcgtatcagcctacgcattcactaaatttggtggggagtgatggagtcgaaccacccgagtcgcaatgacaacagatttacagtctgcaccgctacctctacggaattaactccccgtgatacttttatttattcagtatatctcttgaactgtaaagcaaaatcttcatcaaccttagtcaagaagtgtcctgctttaaatcgtttagagctaccttcaacttctacaccgtatccatttttaccaaggactcgaccaactcgcatttcaccagggtcacccattgaattacaacgaacaccatatagaacaaaatcattttcgaataccggagtttgtttccgatctttaattaattctatcatattcaccttaaagcatattagcattacgttttaagttttcacgaactcgataaagatttgaacagaattcctgttcagtcaggacagtttcgttctttttggacttacccattgaatgggttaatgtagagttctgcgtagccaggagtgctctcttgaacccttcattatgacctaattgattatatgctcgttcgataagaagcgtataagcgtcactctggcgttgcataggcacacctttccaatacagagtttgtgtacgccaccaattctttttcttacctttaaacttagccgctttaccaactaaggtacaaacatgttcttgcatctcaactgaactaaatttcagtgattgtaaaaatccttccatcgaagcacattctacaccatcaattgtaaaagcatgtggtgcaaagttacttaatgctgatgaaggatatgaacttccagagccaatgtccatttaattaccgtgcgatattctagaaggtttcttatcaaaataatattcatacgagccatctaaacgacctgctttagtacggcaatatgaatcccatttcttatgatgccgccattcatcattatatcttggatgacggtcagcgattaaaatctctaatggccaaccaggcgcaaaggaacggagccgttcgacctttctaatgtatcttttctttaagattttcttcatatagattccgacattacgtgagtagttctctttctgattgtaaattgagttaattcatcaacttcaccacaacgccaagcgtcatcttcagtttcaaaaaccaagagcctcgaataagttgcctaaacgccagccttcgtcaaactcagggtcttctgaaaaatagtaatagtaatcgccagttactaaatcttggattgtaagaatccctccattgatgcacattctacaccatcaattgtaaaagcatgtggtgcaaagttacttaatgctgatgaaggataacctgagcctgaaccgatattcattaatcaccccattgcataatcatggcaatatcatcaatatctgttacgatgttttcaatttcatcgataaaattagacagataaggaacaacattaggagtataaagccaattagcacattgaatacactgattgcctactttatcctgaaagattacagcttcggaatggcttccacctttccattgtattaaggcaaatcctaatggatatttctgatgcattatattttcctcaattgcctgtgttaatttaaaacgatttccctgctctatcacgatacgtttaagaggcttattgtgaaatcgagtctggtgccccctgatggattcgaaccatcgacccacagcttagaaggctgttgctctatccagctgagctaagaggacgaaatggtggccccatccggacttgaaccggaaacctaccagttatgagccgggcgctctaaccaattgagctatagggcctgaataatttggtgcaccgagtgggacttgaacccacaatccataaggcgtatcattttaagtgatatatgtataccaattccaccatcggtgcgttctatttcgaaagctctcactggatataacccacgtgattatatctcttatgtttgtctcgacttcacagatcgcgtattccatttgtcgtctagagaactttctgaatagaggcctcaaatttaatagagggtataggattagctcgtggctatccttgaggccaaattggagtcataactccaggtagtaataataccactttattttaaaagcatattaatatatgtgtgttgaatacgtttaagcttcagcttattttcaaagatatcatattcacgaacttgtttaccatcttcagaaacaaagaaggaaaggttcacactgttgaattcccaactgatatctttaagtcgaacatcagtagaactacgaccgatatcaacacgttctacttcatacaagtgctcagcaccattttgttcaatataacgttttgaagcttcttggtcaggcagataaccattttctggcttagtaatttgagcaaacaatttcattagcagttaccttctgcgacaataacatgagttttagcattaacaatctgccaccattggaagcgaccgctgccataacgaggcctgtcttcgttggctgcaataatatcacgcagttcatcttcagttgccgcttttgctataaggtcatcataaccgccgcgtggataaaagttatcacctgcgaacaaaaggaaattcaccttacctgaaggaacgtatgcttccttaggatacttattatctgcctggtcaacaacttcaatataacgatacggaatttcggtgttttcaatccagcgccatgccgcaccaggagaatcaaaagaatcaatacctagacgattatcttcatctttagacggattattttcataatccgcatatacataatattcaacgttcattattcacctttagagattttatccataacaaaagatattgaaccaattaagaatgccactactaaagagattatattctcggaagtggtaagcaaatcaagcatgaatcctgcaaacatactaaagccaaaagcagtaacagcggccagtgcagtaacatttctaattaattcgcaacgtttcattttattctccaatcactcatttgttttgatagggctatagtatcatcactagagcccgttgtaaacatttattttagataaattgcgtattttttataaccagccgtctcgtggcgcagccctttttcattagcaaagcgttcaatattattaatttggttctggtcgagttctgaaatatcaaatacaaaaaagtttcgcttattgcctaaagttacatgattagtcaaatcaatactatagagataatttatattatcaatcatagtcttaacagatttgctaatttttacgtcttcattaagaatagattcagcgataaattcctgataagttttcatttttgtttccttaagttggtatgagagtatagtaacacgggtatttatggatgtaaacacttaaatgcaaaaaaggaacccgaaggttcctcatttaaggtcatcagcccaatcaagttttaatggttctttatattcacgatctagtacgaccggaatctgaacatcacccttatagctcacaggaccaacgttataacttaacgtgatatgtggggtgtagtcaggaaaatcatgtgttgcgcctaatgtacgtgcgtattgatgtctgcaacgtaggtactcagaatcaagaaccagtactaaaaccggtgtttcaccgtgattccacacttcaagatggcctgaagtagcaacttcaaaacttccacttgaaacggtataaggaatatttacacgagagtaacaaatagtagaatggagtttttcacgaggaaccggattaggaacacgtaaagagcgttggagttcttccaacgcgtctaaagttaattctgagaatttagcagcaacataaagtcctgtgctaaaatccttgaagttcattactcaacttctacttccagttcgccttgagccggaactagagcttcaaccgctttgatgatatcagcaacctgaatttcttcaccttcaagaccaacagtttttgcaatctgaccaagagcgtcaacgaatactttagattgagcgtggatcgcttcggcctggtcttgataatcaaaaagacgtgctttcagtacgattacctggtcctgcagtttctgttctttagttaattctgacatttaaaacctcgttaaattttttgaatagttcatcagttgtgccatcgttttcaataacaatgtcacggtcaataatagggagaccagcttctgtaatatgctgatcagatgaatcgactgtatcaggacgaaccacatgaataattgtggcacccatcgcccggagagcttcgatttcgtgtgtttgtcttacatccggaacaacgaaataatcgaaatctgaataaaatttatcataatacttttcagcaaataatttcatccagaacatgcggtcaataccatctacgacaatgtcagttccaagggtctgcatgaaacgtcgaatagtccatggtacattgttatttattgtaagcttttcaatcagatcgccaattgaattaccaccgtcgaatttaaaatagtccagacggtaccgacgtgaaagccaatcaagagattcttggaaaagatctttagcttcataattgttcattacaaatgggcgttcacggtcccactcgccaataccttcccaatcttcccattgaagttttgggtgagcactttcatgattgaatcgacgtttccaagcctgagacaaagtctctttaataggctcagcaagttgatatttgaacccattacattcatttactacatattcggccagcgtatctttaccagaccgctttttgccgacaatagcaattaatttcattttcacctcatagaaggatgcatagccattttacgtccttcgagtctgccttgtccggcatcatcaatttgtggacgacctagtactatattaccatctatttctactgcaaaactcttgaagttaaatgttgccatacaaggcacagcagggtcagaatcttcacgatagttaaactcaatttcagaaaggtctgaaggccaagcaccgtaataatgaatagacatcacaatattctgttttgagttatcaaggatatgaacagtcacagcagaaggctgtccagaagcgtgccaggcttcgctctcgtgtgtcatatagttgtttaatgataacatccatttatagatttcgagccaacctgagagctccctgtccaccaggaagttaaccataagagggtcgaattctatagtgcttccgggaagtttagctcgagaaataccttgtgttccacctggtaaatcgcctactgggatatgaatcccaggcaaagttgctgcttggcagttcaacttaaatgattcggtgaggccattatcagagacctcaaggataaagttagttacgttagtctggttaaacagaccgccattttgaccattcatattcacaccttatacgcttaattcccggacagtgtataatggtcttaggtctgttccattcaataactggccgggataatagattattatttactgttagcccatactttctgagcagagtaacgttttcctttcgaaacaaactgttgaaggggcatgagggttacattagcccaatcggctggttttatttcgactaaaggtcctttaatatttccaggtatataagctttaatcatctggtcagcaccttggaatcctttcactttagtccaatcgatcttcagtttagtagaattcgtgatagtaggcgtgctcgcatattgcttcagcaattcttctaaaaactgttgtctagctttaggcggaatatagtgtaagttcaagccgtacatcaaattatgcttacctaacccaagatatatcacaagtggatatttgtcccagtatggtaatgtgtctttatgtttagcatcatagatataagcgtaaatcttgccaggttgtggcttagaaacctgatgccctctgatacctttctttaatgtctctgtaaaccaacgagccgatttgttgtttacagcagcgccttcattagcaattttatctcttatgcttttacgaaagctattaatcattataagctgacgttcagctttggtcaatttattgccaggtttcttttcaagcttttggacttggtgcgccagcttgatacgcgaagcgtatcttgacattgctttagtgaacgtagcgtaattcaatccacgttcatcggcgaaagctttaccagattgtcctttagcctttgcgttataccaatcaacaccgattgctacccactgttgttcatttttagtaggtttagctgttcgttctgttgattcattgatgaaagaaataatgctcatttaacaccccttaaaacctaattttttaaggccgacttcagttaatattctgaaattaatacccattttatctgctgttgatttagcagctttccatttatcagagttaaccgaccaagtgtagtattcattcataaagcgctttttagaagctgcagtcatattagcaggttgtttaggtggttgtgtttctttagatggctttatttctataaaaaattgcttaccttcgttagtaacaaaccagaaatccataaagtaacgacgtttctttccatctgcattactgaaatagggaatcacaacggtttcagaaccccattgttttatttctttatttgtatcacaccatctcatgaaaaattgttcccatgaagacctataagttattttcttccaatcgcctttatatttttctttattaaccggtatgaacttgccgctgtaagccatttgggttctccttgcatttatcaaaatgccagcatttcattccacgtggtttacctgatttaccacaatgcggacacgttattataggttggcgttctgagactaagcgtaatttttcttttgtttcttcagaacgtttcttgccagtattagacttatttaatttatcttgatgttcttttgtccttgacttggcggcaatagaatttttagatttagtttcttttgaaatttctcgtcctgttaaagatttacttctttttaaatttgattcaattgattgtttcttccctctaagagcttctgatattttattagaccattctttatttctaggagctcttttcattcctttaagaaccactgaattggctttagccattttttccctaacccaactatatgatttattatttcttttattaagtttagtactcatcatatgacaagcataagctaatttatagtttgtaggatataattttaataaaagttgatgggccacataatgctcagcagcagtcaaatctactagattttcttcatcatcagaaccaccaatacatctagggattacatggtgtctttctttgtaacaagttagagttcgcgttttagccctattgattaagttatcataatgcattttgtagttcattgttttctcctcattaaaaatacattgtaccacacatcgaaagcaaagtaaacttataaatattgatatacttatttataaatggaggctttatgctgttttcatttttcgatcctataaattatgaagccaaaactattaagaaaaatgcggcctcattaactaattcggatgttcaatctgctcctatggcagacatcttccgcgactatatgtcatatttcaaaaaagttgcagctaactataaactcaagacttattatattagtggtgctcctagaccagaagaacttgcatatcaaatttatggcaacactcagttatactgggttcttttgatgtgtaataccacttacgacccattctggggctggattacaggtcaagaggctgcatatcaagcatctattcaaaggtacaaagatgtaggtggaaataaagttctttatcatgtaaacgaaaatggcgagaagttctggaacttagttagttatcctgatgcgccacagacttggtatgataaaggcgatagaaatagaatgtacccacaataccaagggcctcttgcagccgtagatacttatgaagatgctattcttaaaaatgaagctaagcgtgaaataaagattattgacccttacgatatcgaatcttttatttctaatcttatccgcgaaatggaaaaagccgtatgattaatatcagtgattcagtttcatggttcgtcggtgttgttgaagaccgaatggaccctttagaacaaggtcgtgtacgcgttcgtgtgtggggtcttcacccttatgagaaaactcaaggtcctgtaaaagggattaaaactgaagaccttccatggatgtctgtactccagccaacatcatcagcatctgtttccggtgttcagcaggctattactggaatggttccgggtactcatgtgtatggtcatttcttagacaaatggaagcttaatggacttgtattaggaacgtattcttctaattcaatggtcaaggctaatcctaatgaaggttttgctgacccaacaggacaatacccactttatcttggaaatgatacaaacccattaaaccgtggtggaattcctggtgatgattctacggttaatattattcaggatgctaaccttgatgttggtattaacccagatggaaaacctttatctgaaataccagaagataacaatcctaattatactattcaagcgatggttcaacatgatgaaggtcttcgtttaaaagtttaccgtgatttaaacgggcgcgggtggacagtagggttcggtcactatattagtgataacccaaatttaactaacgaccaaataaattccgaattatctaaacaggttgggagagaagtaactggaaatccaggctccatttcaatggatgaagcttcaaaattatttaaagaagatttagaaaaagttcaaagagacatgagaaataatgcagctgtttctccggtctatatgaaagtgaacagatctcgtcaaatggctttagagaatatggcattccaattaggtataggtggattagctaaatttacaaatatgcttgaggccatgtttatcggtgattggaccactgcatataaagaagccagaaactccctttggtttaatcagactaaaggtcgagcttctcgtgtatctatgattattcttacaggcaatatggaatcatatggtattccagttaaccctaatcagaatccaaatggaaggatggttagttttgcaacattagctgccgagccagtggcaagtgaccccgctgatccatgggtcccggaagatactagaatattgtttaaagaacctccttcaagctataaagggcaatatccttatgttcagactatggctactgaaggcgggcatattcaagaatttgacaatacgccaggtcaagaacgttatcgtttaattcatcctaccggaagttatgatgaaaccgctcctgatggtcgtcgtaccattaaatcagtagccgatgcttattatatgactcaagccgattgttctacgatgattggtggtgataataaagtcaacgttggtgggaatgaagtcaaatataatatggccgatgttagacgtcaaactgatggtaatgaaactattttcatccgcggtaatgacactaaaacagtagaaggcgatgggactcttcacgttaaaggcaatattaaaattattgttgaaggcgatgctgatattgaagtccaaggtaatgcgaaatctcatgttgttggaaaccatgagtatacggtagacggtaacctaacttggaaaattgctggaactgtagatattgatgttggtggttcttggaccgagaagttcgcttctatgaattccgttgcatcaggtcaatacactattgatggtagcaggattgatattggctaatggctgaaatacttcctatgagcacagacctttccgaagatatggaagggtcttctatcgacgtcacgttcactgctcaatttttagaaggcgagacgttagagtcaataaatataatagattatgaagccacaccaggcattaatgttgaaggcaatcgattatttggtacttatagagatgtttttgcacttggtggtgatgctttaaaatatagaacaattcaaggacaacttctttctgctgattcttgggactcacttcctggttcactagatgctcaactttattactttaaagcccctaaggcgctcactaagacatttaattatgttgtagagttaatctattggtaccaagccccgagtacaggagggagcgcccctgacgaccctgtcgttactcctccagcagagaaaagaactatcagaaaaacttatttcaaaactatcgtaggtaattggtccagatgggcaaatcaattacgttcgtatgtttatgcgaggccataatgccagctttaagttttaataattgtatgacaacaggccaccaagcgtggccacctacagaagttttagcatctcaaggcaaggtatttactggtggtatagcggttgttatagccggggataaaatagtacctcatactgaaattaaaaagccttatgagacacacggtggttctgttgaaccaaggacaagtaaagtctttgttaccggtaagaaagcagccgcaatggcagaccctatttcttgtggtgacaccatcgcacagggttcaccaaaagtattcattcactaggaaaatataatggcagaccaacctactaattttcagttaactagacaagttaacgcaatcccaaaagtatttgtgggagcaacatttgaagaaattaaaaagaacataattgattggctgtcgggtcaagatgaatttaaggattatgattttgctggttccagaatgaacgtccttattgatatgctagcgtataatactctttatatgcagcaattctctaatacggcaatttacgaatcatttatcggaactgcaaaccaacgttcttctgttgttcaggctgcacaggataaaggatatcttccttcttctaaatctgcagcaaaaacaagtcttcttttaactgtcgagaatgctcgtcctgattacagtattaaaatacctcgcgggactaaattccttgcttatgcacgggaatctcgagttgacccatatccgttcgtagtaactgaagacgttattgcaatcagagataatgccggacaatatcgacctattattaatctagcccaaggccgaattattcgtacagaacttttgtttgacccaactcagcctattattattcaagaccctgacattgaccgtaaagaagtcaaattgaaagtaaatggagcagaatggaccgattggactaacaaatcaatggttcatgcgggttctacttctacaattttctatatgcgtgaaaccgttgatggttttactgaattcttcttcggtgaaggtgaaagttctccatcggtagctggcggtgtaatggaagctaactatatcggtgggttaaaaccaactaaagaatcttcaatcgttattgaatatcttcgtacagatggtgaagccgctaatggtgcaacagatttcagttacgctgatacgttaactaacctgacaattgttgctattaccgaaaactatgataatagccctgactatgtcggtgcagatggtggtggtgacccagaagacattgaacgtattcgtgaacttgctgttgttaaacgtgaagcacagatgcgttgtgtgaccggtacagactatgacacgtttatttcagaacgattcggttctattgttcaggccgtccagacatttaccgacccaggtaaaccaggctatgcatttattgcggttaaacctaaatcaggcttatatttgacggcagtccagcgtgaagatatgcaaaattatttgaacggatttaatgtttcaactattacaccaagtgtaattagtcctaactacatgttcttgaaacataatattcgtgtaacttatgcccttaataagcttcaagaatctgaacagtggttgaaagcccaggtcattgaccaaattgatagatattacatagacgaagttgaaatctttaaccgtggatttgcaaagtctaaaatgcttacttatgtagataacgcagaccatagtattttaggttcttctgcgacagttagcatggttcgtgaagtattaaacttctttaaaacaccagcggctggtattaaatactacaatcaatatacaaaccgttctgtagaatcatccgtctttaaattcattcctaccacaggaacaaaatatgatgttagaatcgtagcaacggatagaaatgctacaacaggtaaaggtaaaatggttattggaccgttccgtaatggagatgttacagttggaactctttatactggaagcgatttcaataaaatgtctgcccctgcaaaccaaacacgctattatgtgattggcgatatcgattactatagtgatttcatttattgggatatagccgctataggtttaacttctaataaatttgaagtccagtctatcgagctttatgcaggaccttcgcaagataatatctttactaaagacggttcactaattgtgtttgagaatgaccttcgtcctcagtacactacaataacaatggagccaattgcacaatgactgtaaaagcacctgacgtaactagtttacgaattgacaaactttctgccaatcaggtcagcattcgttgggataacgtcggtgcaaacttctattatttcgtagaagcatgccaaactcgcgataacggggtccctttggacccctctagatatcgttggagaaacttaggttataccgcagagaatgactggtttgaagatacattcgtatcgccgaatcgctactataaaatgagggtggccgtagctgctaaagggtttgaacaatctaattgggttgaaactgaagaattccaaatgttttctcaaaacgcttacacttttgagacaatgcgagaattcactttaagcacaaaattcattaacgaaaaatttgtttttaatcgcccttatattgatttcaaccgtgattctatagttgcgtctttaatggcagagaattttcaatattcacctgcatttaacgatgttagttccattaaaaactttattctaaattcagaccagttccatgaaatacaaggccctatcgaaaaggtgtgtattgatgtagaacgaactatgctggctgaaattggcgacgttctttacttattcgagcgcttccaaccattggtaaaagtttctaacgataaaggacagaactggcaatatgtaaaattatttacagaccgtgttggtaaccctgtttcaagaattccttattaccagtctaataccacaacttatgttttgggttatgatcgtgtgttttatggacgacaatctaacgatataagatggtcttctgatattgttaaatttagctctcaagacgtgacatttgctaaaataggtggccaacttaaattaggctttgatgtagaaatctttggtgattatgcaagactaccactggccatctctaagatagcagaggcgattactgtctctgatgactatatctatgtggtcgggcgtgataaagtctttaaggctaaaactaccaacgctcctgttgatacagaccctaactcaccaacattcggtgagaagatgtttgaaaccggattttctaatatcaccggcaaccctaaagctgtatgctttaaaatggattctgttgatggtagagtattagcattaattacaggcgaagttaaaactctaggaatggatcctactgtcccttctaatgtcatcgattctgaatctaaaggcgtttattggcttgacgttgaaaccgatacatggactcgtgtatttggtaatactcaagaagaacgtcatcgtattgagcatggccggtcttcattaggcaccgacggtaaagaaatatttttctccagtagcaactttaaatttgaagtagaaactgattctgaaatttctgcaaaatatcctgagttggttaattctggtgttagttatgtatatgcagacgaaaaaattcatgataagcattacttaatgatgagctttagaacatcagcagattcagattttaaagagtttaagccaggtcgaatgacttattatgcggagcctttctttggttggtgcagaagagattctgttcgttcttggataactaacagcaatagagcaatggttgtttattcagaccagctttatcaaaagactatcgacccgtatggttcaggttctccggacaggattgttcatgaatactgggaaaaaggccacgtaaccgtaacagcacctaatatcgaattcaaaggattcaaaaaatatgcatcaggtattcttcttcataaaaataccggtgagataattggctacttcgaatttgattatcgtgttagagacgaagccttgattttctggaagccaactgaaataatgtttacggccgacctgcaaaaccaagaacgtgaaataccgtggactcctaaagtaactaattctgaacgagacccagacctcagaccacttcttactaaaatggttcctgacagctatttgcttcaagatactaattttgagaagttctgtgagtattatctccagtttatatcagatggttcaggtacccagtataacaacctattgaatcttattcgtaacaaatatccaagagaagaggatgcttgggaatatctgtggtctgagatttacaaacgaaatatttacttgtcaaaagataaacgtgatgaagtggttcgtttctttgaagcacgtcaatctgatttatggatgacaaaaggtacagaagcttcttataagttcttgtttaaacttctttataatgaagatgttgaaattgacattgagtcaaaaaatactaccgaatatgatattatcgtggagtctgataacatcaacgaagatgttgtaggaacaagcatttatactcctaccggacgtagtaatgtaacttatatcgagcgtgaatataaagatggtaagcttagatggcgtatcactattcacaaccttttaggtagatacttagttggtcaagaaatcaaatcagacataactggattcaaaggaatgattatccaaggtgttcgtggtaaagatttaatgactaacagcattgattatatcgaccgtaacagaagttattatgttatgacgattaaatctaatctgcctacttctagatatcgtaatgacgtcttgagatttgttcatccggtaggatttggcttcattggtattacgctcttaacaatgtttgttaatactggtttgacattaaaacatgttgaaactatattaaataaacttaaaaactatcgttggtccgatggaattccatcagaatggtatgacagaattgcatctttaaatagtgccggtgaagttaaccgtgaccctgttacaggcgaagttatttacttgattgctcctaatgcaggtttgccattcccattaccttcagactatgactcagaaaatgataactctattttccaaggtcagactccttctgaaaggcgcaaaaaactaagtgctctgttagaccaaagcggaataacattctgtcaatggcgtgaacttgttgataaacgtcttaaagatgatataggtaatcctagagacccacgtaatccaacacaggtaaaagtagatgaataatagttctgtagtctatcgttcgattgttacttcaaaatttcgaactgaaaagatgttgaacttctatcaatctattggtgatggtgcaaatcaaaacacgatgtatgttactttcggacgctcagaaccctgggcgtcaaacgaaaatgacccaggttttgctcctccttatccagtagatgatgttgaaggaattgaagatatgtggacccatatgatgggttctgttaaagtttacaagtcgatgcttgatgctattactccacgtaaagattggggcgatatcagatatccaaacccacgtaacttccaagtcggtgaaatagtagtttctaatagcgctccatataaccgaactgatgcaggttcaggttggatggtttatcgttgtgttgacatcccagacaccggcacatgctcaatttatgaactcactaataaagaagagtgtatgaaattaggtggtaaatggacatctagtatagattctatgataccaccatctgggactcgtgatacagaaggtggtgaaataattaatttgggcgatgggtatctttgggaatatctttatgaaattccacctgatgtaagtattaaccgttgtactaatgaatatatcgtagttccttggcctgatgaagttaaggcggacccagaacgttggggctatcaaaataacttgtcgtggcaaactggtgattatggtgttgtgtttagagttaaggcaaacactataagatttaaagccttcttagattcagtttatttccctaaattcagtttacctggtaacaatggttttagacagatttctattataagtaatcctttagaaaaacgtgttattccaagtgaccctaatgtcaaagctatcaaagagtattatgatgcggttgatttagatcgccattcaggtgaaatgatatacatggaaaatagacctcctgtaataagagctatggaccagacagaagaaattaacatcatcttcgaattctaataagggccttcgggccctttcggggctataaatattgatatacaataaagaggctaaattatgattccacaagtaaatggcaaacttttaatcgacgttggagagattggtaacgcctctaccggcgatattctctacgacggtggtgttaaactcaacaccgatttaaacaacatctataatacattcggtgaccaacgtctagccgatgtatatgactcacagaaattacacgcaaccggatattatcaaaaggtcactaagacttctgatttcgggcctggtgtagaccctggtacccaagctgacgtagatacttcagcaggcaatataatttgtgccgtccgaaatggtaaagtaggcgaaggcgtggtctttatcaatagcacaggtagttttagcacagaaaacttttttgagattcaagtagtagatagctttgtttctattccttctgggaaccttcgtgtgacgactccttttagtaagattaccgtttggtgtgttagtgtagaaggtggtgtagttaaatgggattatagcatcgaaagtatgttcggtgataagtcaattcctttaaacaaaacgttccaactttctaatgttaaacgtgatattcaacttttccctaaaggacaatatcaaacagctaaaatattagcaaccgcttctactacggatggaactaaatataaagtatctgaaatccttttatacgttgatagcgttgctaataaagtatattcgactgaatatgcagttataagaggtggggccacaaacgacgaagatgaattatatgatttgacgtttagctctcctgtaggcgattatataattgctacagtaaatagctcgagcccaacaatgcgcttggctcttaaaatagtagaaacgcaatcatttggggttactatctaatgaaacaaaatcttaatgtaggtaacgttgtagatgacggtaccggcgactacctgagaaaaggtggtcttaagcttaataataactttgatgagttatattatcaattaggcgatggctcattcccacacgccgccggcgcatggaaaacatattctgctacacaaggtgctgtattagcggctagctttggtaagtcgtatgctttgaatactactagtggacgtattaccgtaaatcttcctaaaggtaatattgacaaatataactatgttattcgtctgagagatgtattcggtacatggcagcgcaacccggttcgagtagttcctgctgctggtgacaccattaaaggctctcctaacgcagtagaaattaacagaaactttgccgacctggaattagtttattgctcacctggtcgttgggaatatatcaagaacaaatcaatcgaccgcattgataacaatgatatcgctacagtagcaactcaagaatttattgccacacaaggacaaagggatttcatgaacatcttttctgctcatgattacaaccctacgaacttgaaagttttccatcgtggtaacttattgttctacggtaaagataatgtttttgatcctgttaacgctgaagtaggttctcctgttcctggtaattctactgcactacaggcatatgatggcaaaaatataagacttcgtaacgcatgtaatgaaggcgatactgttatcgttgtgtcttatatggatggtttgggtcaatggcgatcttcatataaccgtagacaagtccgtgttcttgattctaagtatacaaataaaactactataaatggtagtgttattgttgacgatttagaaaataaaaaagttttcaccatggctgaactgggtgttactccggaccaacctgtgaaccctaatgcggttgaattgtctataaactctgttcttcaataccaggcaggtacagctggtttgcctgtattccgttgtgaaggcgccgatactgaagacgcagatgactgttatgatttaggtggtcaatgggttgaatcagccactgattttctttttgatactggttcagatggtattattgttgaagaagttagatttgataaacctttagaacatggcgatatcattactttagtatggtataacaataatattggtaccactctagaacttgaagaaattttgttagagactgattcaagatatgtttctggtatggacacggttaacatcacaggcgatgttcgtattactgatgttaataatccattctggcctaacgtggaacctgtttctcctacagaataccagccaaatacggtaccagccatttttgatttagtatatccggttggaactatttacgaaaatactgtgaaccctaataacccttctacttatatgggctttggtctttggaaaagattggaaggaactgttttagtaggttggtcttcatctcctggtactaggtttaacctgaataataaccacttagatactacaggaaaacagcaaagcactgcaggtggcacaggtggcaatgatgatttgactcttaaagcaggtcaaattcctatgcttagaactgacgacaaagtccttgtcgttgaccctaacggtcctattgtggtcggcggatgtcaatttgacccggatgcatcaggtcctgcttatacaaaatatcgtgaagctcaagctacaatcaataaagaaaatattattgaccctgctagtattgatatcatgaacccatatataaccgtttatcgttggatgagggttgcttaatgtttagtttatcacgttctaaggcgggagtaatatctcgccttgccgattatcttcaatttcggctaaatcctaataaaacagattttgtagcaggacaaagggccgtaggtggtccttcagcctctcaaacacaattaggtattttttatcctactgtccagggcgcaattgatgatttggtaggtcgttgtgatttacctgtaaatactgtagtaattaacacagacggacttccacctggctttactaatcaaacagaccagcttaaatttagtggtgttgttcaaggcgcgcctggctcagaacaaatgatttatgttttaggcttcccggttaaagtcgctgaaggtgataccgatatagcggtagctgctaaagcacatgctgtcttaaccgatgctgttgttaattctattgcgatttcatctgtagaaatagatagtactgactctacggtattaaatattacatataatgattatcagacacatatttaccagccagtgcctcaatatggtatttcgataacccaaactattgtggtagaaggtaaagccgggtatggtaactgggctagaatgggtactgtggaccaaactttgacaggcggcgaagtcgatggtaatattactttgtactattttagaagagaatcataatgactactaatacaatacgtcacgtcagtgacgaatcggtatacaaaatttttaaacccgcgggaaccgcatttccttctaatatcacaaacgttcaggctgctttggcggccttgaaccctattgcgattaatggtatccctaatgcgacacaaaccgttatagggataagtcgatttgcgtctcaggcggaggtagatagcggtacccttaacaacgttagtgtttctccagcaacattaaagtccgccatcctgcgtccacctgcaacgactacagtagcaggtcttactagatatgctactacttcagaagctttagctggaaccgtaggtaatgcagcagtggttcctacaggtcttaaagcttctgttgatgcagcaaaaacacaaattctttccactcaagccactgaattggttatgggtctagctaaaatatctacacaagctgctgctttagcaggtgcagatgatttaactataatgactcctaaaaaagtagcgttagctattggtaaagctattgcaaccgtcccatcatattctaacgcgtctgaatcaaattacggtttagttagaatggctactgccggtgaagttcaggcaggtaacgttggtaatgcagttgcaatatccccggcaaatttaaaaactttaatttctactacttcgagaaatggtttaatttctattgcttctggtgctgaagtcgccgccggcactaataataccaaagctattactccagccgcattattatctagaacaggtaatgaaggtagaacaggtcttcttaaaacaacacgaactgttggctcaggtgatggaagtacggcattagcgtataatgccaatgttatttcaacccaaggcaatcaatctattaacggtggattaactcttacgggtcttcagattaatggacaggctaatataacatcaaatacggtaattggcggcaatttaactgtatcaggcggaattacttctagaggacaacaagttgttactattgatatgataggcgacgacgtccctgtaggtgttattgttatgtggattggcgctgcaaataaggtcccggctaaatggcgtatttgtgacggtggatatacttattcagcatcgtcaaatccggctctttggaacgttttacctacaggccgtgttcctgatatgagaggtctatttgttcgtggtgccggggttggtgctgatattcttaatgcacaatctccggatagtaaaggtaaaccaggtcttggtgtaggttgtggcgctggtgcagtcggtacagttcaggcccaagctgttaagaaacacaaacacaacagtggttggggtgaacaccataatcgttctgatgcatatttcggtgctactaaccgcaatggcttacgtggtaataatagacgtgatagtgacaactatctgtattttactaacgatggtactgaatacgaggcagaaagtgcccgtgattcatttggtacaatgaaccctaaagaccttatgcaagacgaaaaccgtccttggaacatcgcagtatattatatcatcaaaatccaataaggaattaaaatgatcgaacatttggaattaaaaaatcttccatatgtcgatggctatcctgaagcagaccagaagcgcatcccatgggtgcgcaatggcgaatgtttagacggtgctacgacaaaatatggtaatgatggcacattgaatggcgcgccgttaggaattcagcgaaatgttgaaaggcttgaagaaaattctgaacttactaaagatgctttaaacgtggttattgacaacgttaataacattaatgaagccttagaagcgggttctgatgtaagtataatccaacaggtttctaaaaacaaagaaaatatagaaattcttcaagtccatatgcaatttgctgaagataatattggagacctttatactgacaccgaattccttaaagaagatttaggtgtttatgacccagcgaccgatggatattatcgtcctgttcgtgatgatattgtattcctgaaaaaagaaattggtcaatatccagaccaagatataaatggacaatctaaaccaggcgcagaagcaactggtatgaagcgtcgcattattaacaatagctcggctatcgtttctcatgctgttagaattaaaactttagaggataattacactgattctgatgtaggttcattaagtattaaaattaatgaattgcgtactgaattaggccctagagcaagttctatcggtaagcctgacgtttatactcgccttgattctttagattctgccaccgacgtttctaaagaaactatcgacgaaattaaagaagctatcggtttaggtagcggtgcttctattaacactaggatgaattcagccgaatctagactaagtgctattgatgttaatctgaatactcctattacaggattaaaccctaaagttactagtatagaaagcgccattggtacttcttcagaggcgtctactataaatggtagattatacagattacgagaagaccataatgctttagccgctattgttggtaatgattcaagttcaggtcttcgtggtcaagttgcatggatgtctgaaacgattggtacatctgtcaatccgactcctacaagtattcaaggacgattaacttcagtaactaatatggctactatttcagcttctgatatccaagatatccaagttgaaattggcacaaaccagacaggtttaaaaggttctgttcttacattaactcgccaaatgaatggtacaaaccctaacgggaatactgttgaagaacgtggggtagttaatagtattaaacagctagaatctaataagattgctgacgctcctagagatggccaggcctacgtccgtgtagacggtgcttgggttcttctttcaacgttcttatcaccataataaagggcttcggcccttttttggcataaatacttatatctaatatgaggacctcttatggctacagaatcttataaccctaaacaactcaaggattcgatccttagacgtttaggcgcaccaattattaatattgaagttactactgatcaagtgtacgattcaatccagcgcgccctggagctttatggcgaatatcattatgatggatttaacaaaaactattttgcattccatatcggtgaagaacaacttgcacgtgatttagtatttgacctttcagggcgtggtgtatttgctgtgacccagattgttcgaactaacgttggttctttaacatcgatggacggtcaggctacttatccatggttcaccgactttgttcttggtctagctggtattaatggcggcatgggctcgagttgtaatacgtttggtcctaatgcttttggtgcagacctttcttattttacccagcttatgcaatatcgttctatgatgcaagatatcatggttccacttcctgactattggtataacgatgatactgagatgcttaaagtaatgggcaaccttcgtaaaggtgacttgttaattgtcgaagtttatactcaaagttttattagcgtagacggaatggcagtaggtcaagccggtgttggatatgctcaatcttgttctacagacccttggtctttacaagacaaatatgaagctccttggaaaacaacaggcccagctcgtgctggagaatctactgctcctagacaaggtgcatataacaaccgctgggttaaagattatgctaccgcattaacaaaagaagtttggggtaatgttctcgctaaacaccaaggaatgcagatgcctggcggtgtgaccgtagacggtatgcgtttaatcgaagaagctcgacttgaaaaagaacgtcttcgtgaagaactagatttactcgacccacctttcggtattttggtaggataatatggcaactttcgattcaagtttatttgcaaagctcgagaataacacgggctataataacacgaacgaaactgaaatattaaatccgtatgtaaactggaatcactattctaatgtccaaactttagctgattctattgtggctgaatccgttcagatgcgtggtattgaactttattatatcccacgtcaatatgtcaaaccagatattatctttggtgaagacccacggtctaagtttgataaagcctggaaatttgcagggtatttgaatagctttgatggttacagcggtgacaatacttattacagtaagttcggtatgatggttaatgatgaggttgaaatcactattaacccaaatctctttaaacaccaagtgaacaataaagaaccacaatctggtgacttgatttatttcccaatggacaacagtctatttgaaataaattgggtacagccttatgacccattctatcaggttggccagaacgcaatgcgtaaacttacggcaactaagttcgtttactccggcgaggaaattaaaccatcacttcaaagaaatgaagggattaatattcctgaattcagtgaacttgatttaatgccggttcataatattgatggattggctgataccaatatcgagcaatatgcagagtctaatgcatttaatgaagaagccgctgaattcgtcgaaccttatgtggttattaacggtaaaggtgatatggctcctcctaagagctctccttttgatgatgattttatgtcataaataaagcatataataccccggcttcggctgggaataactcactggaggtgaactttgtttggtcattggtacaattcatctcttcgtcgttacattgttctaatgggtgaccttttttcccacgttcaaatacaacgtatgcgcgaagatactgggatgaaatatattaaggtccctattacttatgcatctaaagaacattttatgatgcagcttggcaaaataaacgccattcaaaatattccttcgcctgatatgtctcctgaagaaagagctgctcagattgcgaagattgaaactattcttcctcgtatgaaccttcatttggttgatatgatgtacaacgcacagtataaaacagcccttcaaaacaggtcgatggcacaatatagggataatgaccctagaaaagcaataagccaattcagtccggttcctatgaaaatgatttttgaattaggcctttatactagaaaccaagatgatatgtttcaaatcatcgaacagattatgccgtatttccagccacattttaatacgacaataactgaactttatactaacgaaatcaaatttgaacgtgacatcagaattgtattccaatcgttagcgatggacgaagtaattgaaggtgatgccgcatctaagcgtcgtcttgaatggtctatcatgtttgaagtaaatggctggctttatcctcctgtttctaatttagaaggtgagattaaaacagtttatctggacttctttgctaatagcaaagaattaaaaccagaaggtaattttgaatcagtggactctgaagttgttcctcgtgatgtagaacaaagcgagtgggacggcgaattaatacagacctatgattcatcaggtaaacctattccggtcgcccctgagccaccaggaccacgaggtacataatgagcgaacttaatattgcaagtctaatggacatcagtgaattgcctggaattgaaggcgaagaaatcgaggtctatgctccattagaactggtcgaagtaaaatctaaccccaacgaccgtaaaccagaccttgaagatgactattcggtggttcgtaagaatttacacttccaacagcagatgttgatggatgcaggcaaaatattccttgaaacagcaaagaatgctgattctcctcgtcatatggaagtatttgccactcttatgggccaaatgactaccacaaacaaagaaattctcaagcttcataaagagatgaaagaaattaccgacgagaaagtcgatactaaaggacaaggtggacaacagactactaatattgaaaatgcaactattttcatgggtagtcctacagaccttatggatgagatcggtgattcatacgaagctcaagaaagattagaaaagcgggttaattaatggaattgccagtcaacgtactgagtgatgaccatccgttgaatgtgggcgataatattgttattcgccccccttctcaactagaaacaaaagttgaagacgggatgacatggatgaaatcgcaatgggatgggaaatggtaccccacgaaatttgatgattatcttagaataaacggtattgtaaaaattcgtttgcagggtgaagaccctaatttattccagacgttcaaagataaaaataataaacgttctcgttatatgggtttacctaacttaaaacgagctaacattaaaacggcttggaccagagaaatggttcaggaatggaagaagtgtcgagatgatatcgtatatttcgcagagaaatattgtgctattacacacatcgactacgggaccattaaggtccaacttcgtgattaccagcgtgatatgcttaaaatcatgcactcaaagcgtatgactgtttgtaacctgtctcgtcagttaggtaaaacaaccgtagtagcaattttccttgctcacttcgtatgctttaacaaagataaagctgttggtattctggctcacaaagggtcgatgtcagcagaagttttagaccgtactaaacaagcgatcgaactgttacctgatttcttacaaccaggaatcgtagaatggaacaagggctcaattgaacttgacaatggtagttccattggcgcttatgcaagttcccctgacgccgtccgtggtaactccttcgctatgatttacattgacgaatgtgcatttatcccgaacttcattgatgcatggcttgctatacagccagttatttcttctggtcgtcgttctaaaattattattacaactactcctaacggattaaaccacttctatgatatctggtcagcagctattgaaggtaaatcaggctttgctccttatactgcgatttggaactcggttaaagaacgtttatacgacgataatgattgctttgatgatggatggcaatggtcagcacaaactatcagtgcttcaagccttgaacaattccgccaggaacatatggccgaattccaaggtacttccggtacgctgattaatggtatgaaattagccaacttgtcttttattgagacaactcctgaaaatggttatttctatcgttataagaaacctgaagaagggcgtaaatatatcgctgcattagactgttctgaaggtcgtggtcaggactaccatgcaatgcatattatagacgtgacagattcccaatgggaacaagttgcagtactccattctaacgaaatttctcacttaatcctcccggatatagtgcataaatatctaatggaatataacgaagctcctgtttatattgagctgaactcgactggtgtttctgtagctaaatcactttatatggaccttgagtacgaaaacgttatttgtgattcaatggttgatttaggtatgaaacaaacaactaaaacaaaagcggttggttgttctacattaaaagaccttatcgagaaagataaattaatacttcatcacaagcctactatttttgaattccgtaccttcagccagaaaaaactttcatgggctgcagaagaaggtttccatgatgacttagtgatgggtttagtaatttttgcgtggctaacgacccagcagaaatttgccgactacgcagacaaagatgaaatgcgccttgcgtcagaagtctttagtcgtgagttggaagatatgaacgatgaatacgctccagttgtttttgttgattctggtgacgcttcagccgaatatgctccaagagaacatggcttgtcgtttgtataaataagataaagcaaactatttgaggaattaaaatggctttattatctccgggcgtagagctcaaagaaaccagtgtacagagcactgtggttcgtaatgctacgggtcgtgctgctctggttggtaaattccagtggggtcctgcattccaggttgtacaagttactaacgaagtagaacttgttgatatgtttggtggtcctactaatgaagttgccgattatttcatgtctggtatgaacttccttcagtatggtaatgaccttcgtactgttcgtgtggttaaccgtgacgttgctaaaaacgcatcaccagtagcagggaatattgaaacaaccattctcactgctggtagtaactataaagttggtgacgctattcgcgtcaaatatctccagaccgttatcgaagaagatggtaaagtaacaaaagtagatactgacggtaaaattcaggctgtgttcattccatccggcaaaattatcgctcatgcgaaatctgttggtcaatacccagcattaggttctgcatggactgctgaaattacttcttcaagttctggtgtttctggtactatttctatcggtaaaatcgtaactgattccggtattctgttgactgaagctgaatctgctgaagctgaaattacttctttagatttccaggaatctctggctaaatatgcaatgcctggcgttgtagctctttatccaggcgaaatcggttctactattgaagttgaaattgtttcttatgccgatttccaaaaaggtaatgctctgcaattgcctatttaccctactggcggtactcgtgcttctgtagccaaggctattttcaactatggtccacagactgaaaaccagtacgctattattgttcgtcgtgaaggcgcagtagtagaaaacgttattctgtccactaagcgcggcgaaaaagacgtttatggtaataacatctttatggatgattatttcgctaagggtacttcaaactacatctttgcaacttctctgaactggcctgctggtttcagcggtgttattcagatgcagggtggtgtttctgcaaacgatcaagttaccgctggtgacctgatgcaaggttgggatttgttcgctgatcgtgaagcccttcatattaacctgctgattgctggtgcttgtgctggtgaaggtgatgcagttgcttctaccgttcagaaacacgtcgtaagtattgctgatgaacgtcaagattgcttagcatttatttctccgcctaaaggtctgttggttaatgttccactggctcgtgcagtagataatttaattgattggcgtggtggtaccggtgcgtttgacaccgacaacatgaatatcagctctacttatgctgctattgatggaaactataaataccagtacgacaaatataacgatgtcaaccgttgggttccattagctgctgatatggcaggcttgtgtgctcgtaccgatgatgtttctcagccttggatgtctccggccggttataaccgtggccagattctgaacgtcattaaattggctattgagccgcgtcaaactcagcgtgaccgtatgtaccaggatgctattaacccagttgttggttttgctggtggtgatggctttgttctgtttggtgataagactgcaaccaaagtcccaagtccaatggaccacatcaacgtacgtcgtctgatgaatatgctgaagaaaaatatcggcgatgcctctaaatacaaactgtttgagctgaacgacaacttcactcgctctagcttccgtatggaaacttcacagtacttagaaggtattcgtgctcttggcggtatttacgaaggccgtgtagtttgtgacaccacgaacaacaccccgtccgttattgaccgtaacgagttcgtggctagcatttatgttaagccagcgcgcagcatcaactatatcactctgaacttcgtagctacatctaccggtgctaacttcgatgaactgattggtccagcctgataaacgccagggctctttaattagggccctgataaatctattggctgttgaatttaaatcaatcaggcgccgcctggcaacgtataaatatacaaagagagactacaatggaattaacagatatcactcgcgcgttcgagtcaggtgactttgctcgccctaacttgttcgaagtcgaaattcctttccttggtaaaaacttcagcttcaaatgtaaagctgctccaatgcctgccggtattgtggaaaaggttccagtcggttatatgaaccgtaagattaacgtcgctggtgaccgtacatttgatgattggactattaccatttacaacgatgatgctcatgacactcgtcaggctattgttgattggcagaacctttgccatggtatgactaatgaaatttctggtgcagctccggccgattataaaaagacggctattgttcgtcaattccatcgtgacggtaagcgtgtaaccaaagaaattactatcaccggtttatggcctactaatattggcgaagtccagatggactgggacagcaataacgaagtagagacattcgaggcgactttcgcaatcgactggtgggaataaggtaataaatagatatatcaaggagcttcggctccttttcccaaaacttcggagactctaatggcaggatttaataacggcattttaagtatttttgctccttgggcaaaagccgatgagaacgaatataaagaacaaattaataatgacttggagtccatcacagcaccgaagtttgatgatggagctcgtgaaatcgaaacgaatgaacgagaagttccatataacgcgcttatgcaacagatgttcggtaataacgaaccgactcttaaaaatacgcgtgaacttatcgacacatatcgcaatttgatgaataactacgaagtcgataatgctgtggctaatattgtttcagacgctatcgtttatgaagatgaccatgatgtagtggctcttaatttagacggtaccgattttagtcagaatataaaggatcgaattcttgatgagtttggtgaagtactaaattgccttcacttccaacgtaaaggtactgaccatttccaacgttggtatgtcgactctcgtattttcttccataagattgtcgaccctaaaaacctcaaagcaggtattcaagaacttcgtcgtttagaccctcgccaaatgcagttcgtccgtgaagttatcactaaagatgaagctggcgttaaaattgttaagggttataaagaatatttcatttatgacactggtcatgaaagctatgcctgtgatggcagaatttacgaagccggaactaaaattaaaattccaagatcggccatcgtttatgcccattctggtttattgtcatgctgtggaaaaaacataattggttatctgcatcgagctattaagcctgcaaaccaattaaagttaatggaagatgctttagtaatttatcgtattacccgtgctccagaccgtcgtgtattctatattgatacaggtaatatgccttcacgtaaggcagcagcacatatgcaacatatcatgaacacgatgaaaaaccgtgtcgtatatgatgcaacgaccggtaaaattaaaaaccagcaacacaatatgtctatgactgaagactattggctgcagcgtcgtgatggtaaagcggtaacagaagttgacacaatgcctggtgcaaccggtatgtctgatatggatgacgttcgttatttccgtcagtgcttataccgtgcattacgtattcctgagtctcgtatcccttcagaccaaaatagtggtgtgatgtttgatgctggtgcaactatatcacgtgatgagttagcatttgctaaatggattcgtcagctccaaaataaatttgaggaaattttcctcgaccctctgaaaaccaaccttattctgaagaaagttattacagaagacgagtgggacaaagagataaataatgttaaagttgtgtttaaccgtgatagctatttcactgagatgaaagatgcagaaatcatggaacgcagaatcaatatgctaactatggctgagccgttcgttgggaaatatatttctcaccaaacagctatgaaagatttccttcagatgtctgatgagcaaattaatcaagaagctaagcaaattgaattggagtctactgaggctcgtttccaaaacccagatgaagaagaagaggaattctaatggacgatttaattcaagctattaaatcaaacgacctcgtcgccgttcgcaaagtatttgaagcgcatatggcacctgttgtttccagtttgattgaagctgaaaaaatcaaaatcgcacgttctatcatgattgaaggcgaagagcctaaagatgaagacgacggcgatgataaagacgaaaagaaaaagaaaaataaagaagagtctgatggcaaaggcgctgattccagcggtgatgctgatgaaggtgatgacgaagacgaagacgaggacgactaaatgtatcttctccctgaaagctatgaattagtaacggaaaatgttgaaaacttaattccagaagcgcagggtcgttttgatagtctttctaaagcacttgataaagctgatataaataaacttgtagagaacatgtttgaggatggtgatattgatttagccatcgctcttggttctattaatgaagaaatggctttaaacgaatttatcgttaaacacgtttcttctcgtggtgatattacgcgtactaaagacattaaaactcgtcagcgtaatgcataccaaactacaggtctttctaaagctaagcgtcgtcaaattgctcgtaaagctactaagaccaagcgctctaacccatcaactcaggttcgtgctgagcgtaagcgtaaaaaagctcgtgcgaaacgtaaagcatttggattaagctaatgaatgaaccccaactcttaatcgaacattggggtcaaccaggtgaaattatcgatggggttcctatgttggaatcctacgatggaaaagatacaggcttagctcctggtctatacatcgaaggtattttcatgcaggcggagaaagtaaaccgaaataaacgtctttatccaaagaaaattttggaaaaggccgtagccaactatatggcagagcaggttgttactaaacaagctctcggcgaattaaaccatccacctcgtgcgaacgttgaccctatgcaagcagccataattatcgaagatatgtggtggaaaggaaacgacgtatacggtcgtgcaagaattattgaaggtgaccacggtcctggtgataaactagcggcaaatatcagagctggatggattcctggagtgtctagtagaggcctgggttctttgacagaaaccaataaaggttataagctggtcaatgaaggatatcgcctgacggttggcgtagacgctgtatggggtcctagcgctccggatgcatatgtcaaaccaaaacaaattaatgaaagtgcggaaaatacttccgatactagtgccgatgacgcctacctggctctcgcagaggccatgaaagcgttataaatattattatctaaacaacaggactacaaaatgcttaaagaacaactgatgaccgaagcgcagaatattgacgtttccgttgctcttgacagtattttcgaatcagttaatatttctccagaagctcgtgagacttttggcactgtattcgaagcaaccgtcaagcagcaggctattaaactggccgaatcccacattgaatccatcgctgaaaaagcggaagaaaaagttgctaaggctaaagaagaagccgaagagaaagcagagaaagatattcaagaatctgttgctcgcttcttagaccacctgggtaaagaatggctggctgaaaataaactggctgttgaccgtggtattaaagccgatctgtttgaatccgtaatgggtggcatgaaagaattgttcgtagaacacaacgttgtaattccagaagaagctgttgatgttgtagctgaaatggaagaagaactggctgaacagaaacaagaaactgctcgtctgttcgaagaagtaactaagcgtgatgcatatatcaattatgtacagcgcgaaaccgttctgggtgaagcaactcgtgagttgaccgaatctcaaaaagaaaaagttagttctctggtcgaaggtatggaatactcagattcattccctgctaagctggacgctattgtaaatatggtaaaaggttctattaccgaatccggttctaatgaaaaaccgattaccgaaggtgctataaatacacctgaagatgatgctgcagctctgaactttgtttcagaaccggtcgtcgaacaggctcaaaagcctgcaatgtctttagctgacatggctgctcttgcagcatcacgtatttcttaatttaacaaggttattatcacatgaaaaagaatgaactcgtccagaaatggcagaatctgttggaaaacgaagcactgccagaaatcgtaggcgcttctaagcaagctattattgctaaaatcttcgaaaaccaggaaatggacatcatgaattctccggaatatcgtgatgagaaaatcgctgaagcattcggttccttcctgactgaagccgaaatcggtggtgaccacggttatgacgctactaacatcgcttctggccagacctctggtgcagtaacccagatcggtccagcagtaatgggtatggttcgtcgtgctattcctcatctgattgctttcgacatctgtggtgttcagcctctgaataacccaactggtcaggtattcgccctgcgtgccgtttacggtaaagacccagttgccccaggtgctaaagaagcattccacccaatgtacgctccggatgcaatgttctctggtaagggtgcagcaggtgctaacttcccagctctggctgcaggtactgtgaccgaagttggtaaagtttatcgtcatgacttcgcacaaaccggtactgcttacttccaggctaccgaagttgttactgttgatgctgccgctaccgatgctgctaaacttgatgcagaagttctgaaacaagttgaagctggtgtgttcgctgaaatcgcagaagcaatggctacttctatcgccgaactgcaggaaggcttcaacggttctagcgataacccatggaacgaaatgggcttccgtatcgataaacaagttatcgaagctaaatcccgtcagctgaaagcaagctactctatcgaactggcacaggacctgcgcgctgttcacggtatggacgctgatgccgaactgagtggtattctggctactgaaatcatgctggaaattaaccgtgaagtaattgactggattaactattccgcacaggttggtaagtctggctttactaacaccgttggttctaaagctggtgtgttcgacttccaggaccctatcgacatccgtggtgctcgttgggctggtgaaagcttcaaagctctgctgttccagattgacaaagaagcagctgaaatcgctcgtcagaccggtcgtggtgcaggtaacttcatcatcgcttctcgtaacgtagttaacgtactggctgcagttgataccggtatttcctacgctgcacaaggtctgggtcaaggtttcaacgttgacactactaaagctgtgttcgctggtgttctgggtggtaaataccgtgtgtatatcgaccagtacgctccacaggactacttcaccattggttataaaggtgctaacgaaatggatgccggtatttactacgcgccatacgttgctctgaccccactgcgtggttccgatccgaagaacttccagccagtaatgggcttcaaaactcgttacggtattggtattaacccgttcgctgatactgcggctcaacagcctaaaggtcgtatcgttaatggtatgcctgatatcactaacagcctgggtaaaaacggttacttccgtcgcgtgttcgttaaaggtatctaatccttttaaaaaaattatgggagacttcggtctcccattcttgtttctgtacctttataaataatattattatccactaaggaaaagcgcaatggctaaaatcaacgaacttctgcgcgaatcaactacaacgagcagcatccaatatggtcgtccgaatctcgttgctttgacacgcgctacaaccaaattaatttacagcgatatcatcgcggaacaacgtactacacagccagttgcggcattgtacggtgttaaatatcttaccccagataacgaattcagctttgcaaccggtgctacttatggtggtcaagtaggttctaaagatagagaatctattcctaagctgacttctaaagaccagagcattgcacaaggcgattatttcgtatacgagaacattgtttataaggcactcgaagcggaccccctggcgacgactagcgcaacagagctagctgatgctcttaaagaagctttaatccttttaaaatgccgtttagttccggatgctgctagtactgctaaattcgaagataaagatgtagaaatcagcaatgctgtatttgaagttaataagtggaatgctcctgttaaatcacgtaagcttaaaacttctctgactgtagaacttgcacaggatatggaagccaacggcttcgatgctccagcattcttagaagatttacttgctactgtcatggcagatgaaattaataaagatgttcttcagtcactgattactgtttctaagcgttataaagtccaaggactttgtgagaatggtattattgatttgtcttatgataattcacctgaagcatcaagaaaattatacgaagtcgtttgtgaaatgaactctgaaatccagaaaactacttcatattcaggaacatttgttgttgcaagttctcgtgccgctgcattacttgcagggtctggttggttaaaacatcgccctgaagatgatgaatggcttccatctactgcatatggctatctgactaatggactgcctgttttctgtgatgttaacagcccattagattatgttacggttggtgttaaagaaagttatggcggtaatgaaatcgtaggttctattttctatgctccatacactgaaggtcttgatttagattctaaagaacatgttggtgcatttaaagttatcgtagacccagattctttacaaccgtctattgcactgatggtgcgttatgcattatctgctaacccatatactgtagccaaagacgaaaaagaagctcgtattattgatgctaccgatatggataaaatggctggccagtctaacatgtcatatctgcttggtgttaaacttccacctattatctacgaggcataatatggccaagattaatgatttaatttacgaatcaactttgacccaggcgaatagcttgggtcgtcctagcttgctgtcttataccaaagctacaaacaaaagaatttttaaagctcttgtggcagaacaacccacgtcacaacctgtagcagccctttatggcatcagagttctgaaccctgaagatgaaatgacatatcttggtggtgctacttttgcaggtcaatttggaatgaccgaacgtgcagctgttcctgaattaactgcattatcaggttattctaaaggcgatttattcaaattcgaatctgttattttcaaatgccttgaagataatccatttgccgggaccaccgaaactgatttaggcgaaggcgtgtctgaagctatcgcggctgggcatattcgtatgatgtctgatgcagctgttacttctaagtttgaaagtaactcgcctgaaatttctgaagcaggcttcagaattgacaaatggcagactaatgtgcgttcacgtaagcttaaaacttccttgacagtagaacttgcacaggatttagaggctaatggttttgatgcccctgatttcatcgacaatattttggcaatccaaatggcagaagaaattaacaaagatgttcttcagtcactgattactgtttctagtcgatttaaggtccatggcgtgtcttctaaaggcgtgttagatttaactgatgctctttatgataatgctcaggatagagctcgtgcactttattactatatgtgtgaaatgaactctgccgtgcaacgtaatacttcatttgccgggacttatgcggttgctagttctcgttgtgctgctattttagctgcatctggttgggtagaaaagaaagatgatactgaccctctggcatatggcgtgcttaaaaatggccttccattatatgcagatgtaaacagtccttgtgattatgttatcgtgggtgttaatgctgatttgggtgatgggcagactgtagcttcgctgtattacgcgccttatattgaaggtgctgatgatattcaagaggaaagtgataccccggtaggttctcacaaagttatcgtggacccagattctttacaacctgtagtttctctgttaagtcgttatgcactgtctgcaaacccttatacagtggctaaagatgaaaaagaagctcgtatcattgatggtgcggatatggacaagatggcgggtcaaagccaattgagttcttatcttggtgttaaattaccaccgttagaaaaagaataagggagccaatggctccctttttttcgtttaattgcttactaattcaatccatactggacgaattacaccttggacataagtcacaagttctttcttaactacatcaggctggtctgcatcagtgataaagatttcttcgcgagccgcttcttcaagaatatcttgaacagtcaggcccattactttaccgaaatctttcggaccaatttggccaattttactgataacgttgtttacacgattcagagtagcgtaagccgctagagtagacaatgcaactttatctacatcggtcagaacagctttaggcttaattggtttatcagattttgatttttcactgaacttagagttcttacacttaatagccacacgagagccattagggaagaacttaggataacaaggcttcagaacataaccttctgcgacattcttattttccacttcaacttggaatggagtgctattagcttcttttagcccatgggcttcaatagctttattataacgacggacaactacatccaggtcattaggtagtttagataattcatcaaacttaccgcggccaagcaatggggctaatttgaaaccgaaagtattacaaatctgttccatcatataatcgtctacaaactgattagtaccttctgcggttttaaccaggatatcgaatacgtagaaatctttctcgccataatcaacacccttctgaattccaccacctgcaaactcaccgaaaatctgcatcgacgagccttctttaatagtgtgctgaacagccttgatactgtcattatatttcttcaggacaatttcataaccaaagaaatcttcacctgctaagataggaccagtgcgcttcgcgcatgtgactgcgtcacgttcaattatgatagagaagtttgtaccgtgaatcttctcacgtgctacccatggttcagttacatcaaaaccagcattacgaatcttctcaatgaacttaccgttgtagtggttctcaagactggaatatttctcaaacatatattaccttataaatatcattataaattagaaagagagtaactaatcttcttaccaccaattactctcggcttgtaaaccattatacctaatatatcacaaaaattcttaaagcatattagaaaacaatttcgacccaatcaccatcgcgttgatcgtgtttccaattcaccattacgccgtcatcttgcatccatttagtcaactggtctttgtatttctttgccagggctgatgggtaccagttaaattgacgtttacctttcttagcctgagccagaaattcctgttcaacttcatctttcgcctgtttaagctcatctgaagcgacagagtccgccagggcaccgtaatgtgttgctaatgatgtaatacgttgctctttagtagatggcttcagaccgccaataggatggcctgcctcgtcccaaccttggatacgacgttcacttttaaattgttcagaaggaaacattgggtcacgcattgtagcctctcattttctcaattaatttagtgtggtccgtgatgtatcgtttacgataaacaactttctcacggttctttgcacgttcctttgccttctcaactttcatccaatcctgcatagcttctttagcactgatgccgaactgtttagcaatatcaatgaacgtgacaccgttctcatgcatcatatgaatcttaattgctttcatttcatatctcacttgtgaatgtagagctattaaatcatgtatttttaaagcaagaaatttcttagtggtaggaaggctgagactgtaggatatagcgggccgaagcccgctataaaattatttgagtgttacgaaagatgagttgcgtgtttctctaacaagaatagaaccatctctataaatgtagtagagtaagctgaatagcgtctggtgcgcgctaggatgagggaagctggtaggtcgagatttccaatccggagtctctttaatccattggtaaatccaccaaggtagagttacatagcctggatttttgcccatcagaataagatgaggactaaagtcagctggtaatttaaacggctcagatttttccgattcaacaatttgagctacagcttcttcaattgtgttttcacttaaaactggctgtggttcaagcacttcaccaataggagcttcaacacggagttctttttccgggatttgaactgggacttcaattacagatggtgtttcaaatggagcatcaaacaacagaaccgcttcttctttagcttcggtttcaccttcaatatgagctttagcaccactgatttcatcatcggcgtcaatcaaatcactgatactcaacccaccttccacttcatcaactggttcagcagcaagttctttaagaccggcttcgatgtcaattactagattatcaaaacctttagattttttgagttgaaggccaaactgttctgcatattcaataagtttagccttagcttcttttttatcgtctaattgacggagttcttcaatatactggtggtccataatcattctcttttctagtgtataaatatgtatgtatttataactagagaataccctcatgcaaattaaagttcattttgaaaattttagtcatgtacgtattgagtgcgatgaatccactttctacgaactaagagactatttctcattcgaagccgacggctataagtttaaccctaagttcaaatatggtcagtgggacgggagaattcgtcttcttgattacaaccgtatgttaccgtatggtctagttccacagatgcgtaaatttgcagaccaattcgaatacgaattgtgggttgaccctaaaatcacagagaaagaagaaatcactcgtgaagggtttgattcatggttatctgaactagaaatttattcaggttcaactaagattgagcctcattggtatcaaaaagacgctgtgttcactggcttgaccaacagacgtaatatcctgaatttacctacatctgcaggtaaatcgttaatacaggcactcctgagtcgttattacgtagagaactatgaaggtaaaattcttatcttagttcctactactgcgctcgtcgaccagatgataaatgacttcgctgattatcgtttattcggtaagcaacatatgctaggtattcgtgctggtactaagcgtgattcggatgcaatgatttatgtcagtacttatcaaactgcaattaaacagcctaaagaatggtttgcccagttcggcttattcatgaatgatgaatgtcacttagccacaggcaaaagtatttccaccattattgaagggttaacgaactgtatgttcaagttcggtctttcaggttcactgaaagacggcaaagccaaccttatgcaatatataggtttgtttggtgatatcttccgtccagtatcaacttcacaattaatggatgaaggcgctgttaccgaccttaaaattaactcaatattccttcgttatccggatgaattctgcgttaaaatgaaaggtaaggactaccaaacagaaatcaaagttattaccaaagcagaccgtagaaataaatgggttgctaatcttgctgccaaattggctaagaatgatgaaaacgtgttcttgatgtttaagaatatcgaacatggtaaaaaattggtagagttggttaaagaggctggtgcagaaaaagtctattacgtttcaggtgaagtcactactgaagttcgtaacgctttaaaagaaatggccgaaaacggcaaaggtattgttgtggttgcgtcgtatggcgtattttctacaggtatcagcgttaaaaacttacaccatgtaatttttgcacatcctgttaaatctaaaattattgttctccagactattggccgtgttcttcgtaaacatactagcaagaaagttgctcaggtctgggacattattgatgatatgggtgtcaaacctaaatcagcaacagccaagaaaaaatatgttcatttaaattatgcattaaaacatgctcttgaacgtatccagcgttatgctgacgaacaattcaactatgtaatgaaacaggtagaaatctaatgaaatcatttgccgatattatctatgaagccagtattgaaggctttatgtctaagattggctcttgtcagaccctagatggtctgaaggagcttgaaaaatattacaaaactcgtgtcaaagaaactgatttgaaggattctgacgatatcagcatcagagatgctttagaaggtaagaaagtagaacttacttctatcgatgatgaggaagaagaggaattttaatacaaaaaagccccaaccaaaaggaaggggcaaaaccaacaagttggttatctcactagattaaaagctgagtctcgtttaactgctcttcggcagattccgttaccggcaaactttcagcataattataacattggccaggatggcatggacctcggtctgtttcaacaaccaatgcatcgtcgattggcgttttacagacaacacaaatctgcgacatgattgtctccttagttgtttgtatatgtttatttattacgttttaaggccgcattaataaattcttggaatttacgcatacgttcttcagatggtttagggagcttattaattaagcctactttacgacatggcattatttttcacctgcttcgaatttacggatgtctaacatcgttttcagtgagaatccacgagccttgattgcatcaagtgctgaactacaaaaatcttgcaacaacccccaatactgcatttgagtatcaagttttaagatgcttgaatctgcagccatcacagtcttcatttcagtaggcgtatattggtccatacagacttcttcgccaggctcacttcttccggaatagaaatctaaacgctttttagatgcagattttttctgaatctcgatacgcataatttctttcttacaattactatacagacgtaaccacttactgtgtaacagcacgttgtgttgtacttcatattgtaatttcgtcccgtcgataactaaatctttatctaactcttcttggaacgcctctaatttaaattctagtgccataatgtttcctgttgtttaacccatagacccattataacacaaggcctatagacagcaattaaccaccacttctgagctggattctaatttgctctaaagtatccgggtcatcgactattgaaaagcgaaccgtaacaattattgagttgtcatcatagattggcgtcacttgaacacccaattgagacactcttggctcgaagtttttaatagcagaaacaatattacgctgaatagtatcggccactagaggagtcatgttttcaaaaagctggtccgttatatcacaaccaaattcaggttggaaagggcgtgagccctttcttgtagtaacgataccgagaatactatttttaactgcacgtgcgcctactactttagcaacatcataacgatagtctttctgcatattaggcgacagatctgagtacattttattgatgttcattatatcaacttaaagaactctttaagccccttgacaacatgaatttcgttatggccgcactcacaagagataggcactgctaattggacttgtggttcagtcaaatgagcgaaaatcttttcaatatcttctactgtgatagcagaataaagatcatttacttcttcatctgataagtcatcagggaagatttcgacatcatcaggggtaacaatagaatgaatgcattctgctacggtttgggctttgtatttgtcttggaagatattaggccatctgaatctaattttgaagttagtaaaggcccagacaacgtccctggcttctgtagtactcgcctgaataagattcattggaaccatttgttcccgcccacaggcgcaatgccatggacgttctacgttaacttcacctaatgattgggcccacagtttaaccagcagtaattctccttcatggcgagggagttcaggggcgtctgtacatttcttaaacagttctaaaatttcttcttcaagtcgcccttcgagttttgcctttaaaaggtctttatattcacgtaaagtgaatgcacgacaattgatggtcttatcaccaatcttcgtcacaaaattatagttcatagttggctccttaataagcgtatttataaatacacgaaaggagatactatggcaaatataatcagatgtactatgccagatggtgtccatcgtttcaaaccgtttacagtctcagactacagagatttcttattggtccgaaatgatatggataactatccggaagacgaacaacaaaaattaatggatgaactgctagcagattatttcggagattatcctgaaagttggcgcccatatcttttcatccaagtattcacagcttctattggtaagactaaaattccagttgcatttgaatgtaacgaatgtggtgcttcaaaacaacgcctttttaacttggcacttcctccactaaaagaacctgaactagaaacagctggggttaagataaaatttaaattccctgataaagattatgaagacaagacccaaatgattttagaaaatataaagtcggtcgaagattcagacggtgaatataagtgggaagacataccggaagaaacacaaatccaggttattgacgctatagatttagaatctttagagaagcttataactgaaatgaaaccattccatattaagttcaaatatggttgttgtacacagcatgttgcttattatgataaaatggtggatattttcaaaatacttttaaaccctagtgaagtatttagtttttatcaaataaatcatctgttagtaaaaagccactacacattagatagcataatgtctatgcttccaattgaaagaaatatcgcgttatccctagtagaaaaggaccttaaatgactaacaaatctatacaacgtgaaggttatcctaatataagcataaagctttatcaggactatgatgcatggcaaactaaccgttttgtagagttagctgcaacctttactacattaacaatgagagacgggcttaatggtattaatgaaggattacttcaattttatgatgccaaaaacctccatactaaaatggatggcgaacagataatccagatatctgtcggtaatgcaaactctcaaagaacacaaacaagaatttatggctgtaaacactttgctgttggcgtcgactctaaaggcgataatattattacaatccaacttgcaactattcattctttagagaaccttaaatttggtcgaatgtttttcccatctgtccaagaaacacttattgaaatgcttggcgtcatttaccaagaccgtacattacttactcctccagtgaatggaattaacgtgtatgtgcctaatgtcccttggtgtgacaatataaaccgttatatggccttcgtccgtgaaatgggacttgctgttgaaagtgaccaattcgtattttgttgggaagatatcgatggtatagaaatcatggactaccaatatatgattgaacaggagccattgaaattcgcagtgggcgagccaaggcttattggtcaatatgtccaagatttagaaatgcctattgcatttgattttgaatggatgactaaggccaaccaacatactaaaaagccgtatcagaacgctactttatatgctcactcatttttagacaaaaacgccacgcgtgtaacattcggtgaaggtcagaacagtatatttgtttcacgttctggtgcatatgccgaagcaacgtatagaaatggctatgaagaagctaaccgtattattacaatgtctcaatatgacggttatgcaaagtgcaaagtattcggtaactttgaagtaactcctggtgataagattaatttctacgaccctaagaatcaattccaatttgatttttacgtagacgaagttattcacgaaataagtaataacacatctatcactaacatctacatgtttacgaatggtactccaatcaaagttgaagaagtgcctaaggttaaaaatgaacttaaaacttattctcccgacgaagaaaatactgatgaatcagaaggaaatcagtattccaaaactaggcttaaaacatcataatttagttaaagatgaaaaggaccctgtaaaggcccttcgcatgattatgcgaactattcatcctgatttagatgcagccgaaactgattttgtatctttacatcttttagaattcaatggtaaattaaagagtgaagttgttaaagatggctttacttatcgtttagctgatgtttatatttgccaaagacttgaattccaataccaaggaaatactttcaaatttaggtcacataaaccgtttgaaacgtttggacctgtcgatgcggttttgcaaactctttatctcggtgacgatgtaccagattttctggatatgcctgctttcgtagctaaatgggcagatgatataacaagcactgtagctattcctggtcctaatggtcccattaaaggaatgcttgaaataatggaccttttaaatgtcgaataaatctgaacaacagagttttcgtcgtagaaagattattgaagagtcggctcctcagcgtcgtgctgaggccctggcttccactcaaaacgacgaattaagtaatattggttctcaactacaagacgtccaggcggccacagagatggtcgctgaaggcattgaacaacaaaccggagtaatacaaacatcattagacaaaattggtaaaaaggttgatgatgtcgaggccggtgtagaacttgtagcagaatcatccgaatcaactgcagccgcagctaatgaaacttctgcagctgcaaaagctatttcaaataagttggcaaaactttctgaaatgctttctgctaaatttagtgcagaccctagtcgtgttccacaagcaactgaaactgcagtggctgcggtagaatctaatatgcctatgccggttgaagaaccaaagcttagagagctgttagaaaaattaatcccgggtgatgctccggctgaagacgctccattccttcctcctgtggttcaacctccacaagaagaacaaaagcaggataaaccgtctaaacaacctcctgaaggtagtaaattagatgatcttttgaaaacaactaaaaagggttttagtgctattgtaagtgttactgaccgaattgccggaatgcttttcaaatacactattacggctgtagcacaggctgctaaattcgccgggatgttattagcattagttgttggtatcgatatgattcaagtttatttccagtacttcatgaaagaatttaataagtcatgggatgaatttgataagaaattcgaaaaatgggggccattgatatcagaccttttagtgatgactaaaaacgtgtctaaaatgtttgatgaaggaaattggtttaaattagccgaagctattgtcaaaggtatggttaaactcaccttgaatatggccgacattttgatgctcggcatcggtaaattaactgcatcactattacgttctcttggttttgatgaaactgccgataatatcgaaggtggcgcattaatgacataccagcagaattctggtgctgcattaagcgaagaagaccaaaccactcttgctaaatatcaagatagaaaagatgctgaagcatatgaagccaaagtagaatttaatagcagattcaaaggtaaagatgaaggtcttaaagaggctcaaagatacggaactgtaacaaaagaaaccgctcaagaaattaaagctggtaaagtcgattcttctttccgtgatttacctgaatctcaacgtcttgaaataattaaaaagcgtaatgaaactgaagctgctgcccgccgtttggttaatagagctgaagaaattatgtcacctgacgaaagagataaagagaactttaagaaagaaaaagagcgtgttgacactcttcttaaagaccctgctattaagcaagatccggcccttcagtcattgataaagaaaatagatttgaacgctaagaaattcgataaggtccctgtccaggcacaacctcctgaacaaaaagaagaaactattcaggctaaacaagttatggaacgccagagggctaaagaagctcagaaaaataccgccaatgatggtaaacttgggaatcttattcaacaagttaacgttcagaaaaataataagacaatgtatactatgcctgctcaaacctctatagcagacccgggtatgcatcgttctgtaaatgtgaactaaggaattaatatgcaggtaaaagaattaacagacgcagagagcggttggaataccggtgaaaaaatatctgccgggcaatctaaaatcgctcctatccaaaagaccataagtgctcaatatcctgcagaacgttcttctggtaatgattctatcggtgattttagagtttatgatctttataaaaatgggctgttatttacagcctatgattattcggccagaacaacacctgatatgaggtcattaagagaacagttccaaaggggattaggtagtggtagcttcaatccattaaaaaactttattagtgggtcatatacaacagacaagtttaatagtactccggtcgccaacttgttattaccacgttctaagtcagacaccgattctgttagccatcgctttaatgatgttggtgaatcacttattactaaaggcggcaattcggccacaggtattttaagtaacgttgcatcaacatcggtgtttggggcaatagaaagtattacccaaggcgtaatggctgataatggtgaacaaatttatactactgcacgtagtatgtatgccggtccagataaccgtactaaagtatttacgtgggaattaactccacgtaacgtacaagaccttattcaaattatcaaaatctatgaagtctttaattacttctcttacggtgaaacaggtaactctgcatttgccgaagaccttaaagaggaaatagattcttggtataaatcaaccttctttaaaaaagaagctatcgaatcatttgatggtcaattagtaggtgaacagattacttcattcctttctaaggttattgttgtaagtaaccctacagtatggtttattcgaaactttggtactacgagttcattcgatgggcgcgctgatatatttgggccgtgtcaaatccaaagtataagatttgataaaactcctgatggtaatttcaatggattggcagtagctcctaacttacctaacacgtttgttttggaaattacattccgtgaaatccttactcttaaccgtggtaatttatatatgggtggtattcaataatgtttacattacaagaattccaaaaccaggcagctaatatagatttccaacgtaataacctttttagtgtggtctttgcgaccacaccttcttctaaatcacaatctttacttgaccagtttggaggggcaatttttaataaccttccattagatacagattggtttggaataaaacagggtgaaattactcaaggaataactacattagttactgccggtacgcaacaattaattagaaaatctggtgtaagcaaataccttataggagcgatgaccaatagggttatacagagtttattaggtgagtttgaagtaggaacttatttgttggacttcttcaatatggcgtatcctaccgcaggtttaatggttcatactgtaaaagttccggacaaccagttgaatcatgaaatggatttaaaccataatgcgcctaacattaaaataactggcagagaatattcgccatttgttttaagtttccgtatggactctgaagccgctaactatagagcatttaatgattgggttaatagtgttcaagatccggtgagcggattgcgtgcattacctgaagatgttgaagctgatatccaagttaacttgcatgctcgcaatgggcttccgcatactgtcataatgttgcaaggatgtgtccctgtgggcgtcagcgcccctgaattaacatacgaaggtgataatactattactacttttgatgtcaccttcgcgtacagggtgatgtctaccggcgccgtaggaaaacaagcagcaattgaatggcttgaagataaaactattaacgctattactcaaattaatggtgaacgttcgttgagctctcaattagccggattaagcagactatcaggtgctcagtcaggaatgactaacttacttaatggatttggtagtggtgggctgaacaccggaataggaaggatagttggaactgggactagcaggttattctaacgaaaaaagggagagcaaaagctctcccttaggggtttatttacggaagcctaagaacgcagggatggtaatgtctggctcaggaagttcatcggctgagttgaaagtatcaaatgaatcaatgtcgataaagacatcaattactactggtgcttcactttcaaattggcctgtaataataccagtgaagatattatcggtatgctcttcatttacgaagtttgccactggacggatgttgaactgagccttttcaccaaacactttacgaagttctgacacaactttttcattgaaagccgcgtctactggacgtacatcttcaacataagcttctttaccatttactcgaatgaatgaacgcattttgatatcctcacttgtgattgagattacatcataacacgttcattcgagcttgtaaactactctacaaatttaggtggagtatcttcaatgtcgatgaaggaagcaagcaaaccaagacctacagcagttgatttaacgaatttactgaagtctactgcgaccggttcaacttcgtccatgtccatagcaaccagtccacccgtttctaaaagagcatcaccatcataaacaaccattgattcgttcagagcatcagccgtcataacttcagcctggatgaatttctgattgctgtagaccatgccatcgttataggaagcatctgtgatcttattaatctgaagcatagtaccacgcggcagaataacttccatttccccagccatattgctcaggtcaccggggtaaacaacgttaaccttatgtgcaccttcaatcgcccatcctaacgaaacgcgaatacgttcttcaccatattcttggaccattctaatttcttggtccggaacaatagcggtttcatctgatttatcaaccgttaaaacagcacgagtattatctgatgccattgctactgcttgattacctttccaaccaccaaagataattggggctaatgaagtagaaacaaagttacggaaatagaatacacggttcttaacgagagcctcgaaaataggcttacggacagtttgtgaacgccataatgtcagaccttcaggtaaacgatcacctctcttgaaagcatcatcaagatttttaatggccgtagtaacttctttttctgttaatgtatcataattagcagcatcataacgacctaaaagcatattattaatatcggaataacctgaaccgacatattctttaatgccacgtttttcggcattagtatattgaagaggggtacgagtcatcgtaattgtttcaatagaagatgaaacgttctttgcatagccctgaagagcagctttaatcattttagtacgttcgatattccaaagattataagccatttcttctttatctttctgctcaagatattgcggaactcgtgtcataatatgttccattgcttcatgtttacgttcttcaagtgtatcaagaagggtttgaacataagcctgcatactttcaacagatgttaaaggcgcattgccaatacggaattgaagatctttagtaaatctttcttcaaacttatcgcgttgagacaattttaccttaactaaactgctcaaataagtcgatgcaccggtagcagccaaactagcagaatgtaaacgagctgccttagagctaatagaatctttaatctgttgtgcttctgggatttccggtgcagtagcaggtttgctgaattctgcagcagaagcttcatattcttcaaatttctctgggtcatgaataatttcagaagtcaatgattgacttgccgcaacctgacgacgagaaatcttagtacgagttacaacagccctgtcattacgtttttcttctacagcggcaatagaaccagcgatagcagtttctttagttacctgtacgccttctttcttgcttacatatacttcgccaacttcagactcaacacgagtataaaggtctggattaataccaggcataccagcgatatcatcgatacgagcgttcttacgaactaccaggacgtatgtatgtttgccggtaaattggaacatactcggaactactttaaaacgtccacctgtcttctgcataacaagacgagcaagaacacgttgaacaataggaccctggcctttcattttcttggtagggaagcggaacataatcgcatccatacgaagctttttgacttgagcatatacggtatcaaagatggtattaacagcgttaataggttcaggaccaagaccacctttaagttcagccggagttcctttagcagataagctcatcagaataacgtgagcgtatttatcgccaagcttgacttgtttaatagcatcgccttcggaaacataagaaaccatacgagctactaattgtgaatctacatcaccaattttccaaatctgtggtactttaagtttcgggttcaagtttacaacaggcattgtgccttctgactcgaacacctcattgagttgttcagacataattattcctcttattagttgtctgtatttatgcctaaaaggagcccgaaggctcctttaccaaagtggtaataatgtacgatacacttcaaagcctggagctttttcgtgtacatcaaacgtagcattaaaattttcccattgtgttggattatcaaactcaagaataatctgggaacatgaggtggagatatctccaccttctttacgtgcaattacaactgtttcaagatatgctttcatagtcctgtctggtcccatgaaccaaatacatcttcaaatgtatctgcgcttgttttatcaaaacggaagcctttaataatcggaaggaagataccaacagtaccatctttacgacccttagagtgcacccaaccattacattcacaatcagcaatacgtccaaccaaattacctgacaatgcttcaaccatcagtcgttcacggtccatttcatcgcgttcatcgattggaatatcaacccacttacctttgaccttaacacgagtcgtatctttaaatccagaaccacaatctgaagtaatttttccacacagtgatttaagttgaacaccaccaagtttatttgggtctttagagtgtggataaaagccgacgatttccattgcaatgtcgataacttctttgaacttaataaggttcttagaacgtttgttttcccagaaggaacccatgttcttcagaataataccttctaagccctggtctacatatttcttatagacttcacgcgcttctttaagattataaacccattggttttcaatcagaataactgaatcaaatccatgaagagcaacaccttcggcgatcatagcttcaagagcacggaagcgaacatcatatgcgaagccgggcttttcgccttcagaataaactacatctagaggaacatagtcccatgcctgtaatttcattccagatgcttcaatctgagagattgtacctttcagagatttattagccagtccatttgaagtagaacgatctacgttctggaattcagccgccttacttaattcttcaggttcttcgaacatgccaaacaagtcattatccgctttaggttcaaccttaggagcatgataaaccagttcgccatcaatcattacaccagccgggtgacgcttacgagcatcttcggtgataatcatcaactctttagcaagcttatgaaggccttgatattcattgcctgcacgagagaagaacttaacaccgtcatcagttacttcagcgaaacaacgagcgccatcagccttaagctgggcgaatgcaggccatttgatgtgtttttcaattagcttttcatcatatgatgaagccaacatctgaggctgttctgggatacaattcttccagattttatttgcaatggtaggacctgtaccacattcaaggtcacgaagtaatacacgacgaataacttcggcatcaccttcagaagtctgagataatgcaatttcaagtttttcgatagccgcattaccggttataacccgtttagccagcttttcttcaagcatataaagcatgtcttcaagagtaagatggatttcatctttagctcttgtaccccattttttgatgccatagttgaagcgtttagaataagccataatgaatacgcgtttcagaagttcattacccttctcacgttccatgatagctttcttttcgttaatagaatcagtcgcagccaattcattcaggatatcaataatcatgttattccttaatagccatgtgtagttctattatacgctaattcttctaacatcaggccaagttgcttatgatacgtgtaaaaatgcctttctttttctttatggtctttatgatgaacataaatgaaaccttgtgaaacgcattcttcaaaaatttcttcgccccgagcttcacgaaaaaccggatacatgcgcaagaactgattcacgtgaccgaagtcacgtgtacgtatctgatcgccatcacgcattaaatgcataacaaacattacttaacttccccataataagcacgaagatcgcttggtttgatgttgcgatagctttctggttgatttttaattctatcgaatggaggccaaccggtctgccaggctttatgtgggctgagttgacgatcaatttcgttttgaatgatttccatattttttgaaaggtcttgacgacgggtttcaatcgctaccagatcgtcccaatctgttattttagtacaatcatcagcagccccatcgcgctcaccacgaaccatccaatacacaggaacgtcaagaatgcgtttagctgcctgacaatggtgtggaaggtcgtcaacataaaacttcagacgggaaccatatttcaggcgaactttcgtcaagataagttctttgctttcgttatgaccgcacatctggatgtcctggaacgcgccagggaacaatgcattcaaattgaattgtctattcagccgagcatcaatagaatcaccaagcgccgttacagctacaaaatcgtaggctttcttgagcctgttgatattacgcaaggcatccatataaggtgccagataacgaataaaatcagagctattgtatttgttaatcaattgctcgccaagatgctcatcacagccaaacagcttacctggtttaatgaacttatcatcctgaatcatttccaggatatgctcgagtggtagattatatttctgtgcgaaataaggaagcccagactgccatgacagaagtacaccatcaacatcagttgcaattacaggcctttcattttgggtcaaagatgtggtcatatttggtccaatcaatttcagattcataagagacaaaagctacggattgcccttgtcgtaaacgttctttaacgatatgcatagcaacacaactcccaggccattcacgctcggagttggaagcaatcgtaataaggcttccaattggaagtccactattcaaaacactacttaaactgccagccataaatctgcctcacgataaacatcttcattaccatccgcccaacgaacagcgtaccaaaacccttcaacatatttgtttgggggtagaaccataataacccaacctgggattgttcctgcgcctgctttagatacagaatctccaggcatgaatttaggtccttcgtcaataacaatcattcttcaacctctacccagtcagggaaaacgaagaaatctggggcatcaaccatatagcagactttatcttctttaacgttacaacccagtacttcaatcatttcattgttcatcaggcaacgagcaagtttaggagctttacatttagaagtcataacgatcataatatttttctcagagtttagtgcatgaaataaggtctaaatcggaccagtaacctaccggatggagattttcaattttcttttcaatctcacggtccacattttcccaaggccatacgttgatagttgtttcaaattcatcttcgatatgaccatctgaatgagggtggcgtgacaccacctcaaatttaagtagatattttgccattagatagtaaactcagttgatactacatcccagattgcttcacgttgttcttcagtcgttttctgaccaagaacatggcgaagataaagtttaaccagaagttggcgattgtcaccatgccacgacgggtgtgtaacaaaatcacgagtacgaacttcatcatggaacccaactttaataacagaacctttgattgatacatccaagcatgggccattttcgaaagcgaagaacacgtaattgtcttcccaatacatatcgatttgagccacagttccattgttgtgtttccacagcagaagtggagataaaccagattcgtttacatatttacgttcaaagttgttgaagttcattttgttatcccgtttaagtagtttgctgattgagtgtacataataccacactcaatcagcgttgtaaactgttattcgaaagaaacttgagttacaaccttagccgttgtttctaaacggaaaatacttacaatagcctttgagctttcttcagcaagaacaaattttgcatgttcttttgcagcttgtaatgtgaaacgttgaggatttgaattagtcccgacaaaatacccagtagagccaccgtattcagtaggttctatgccagatatatggacaatgtattcctcgatgtcagggtccacttctgtgaacatgtcccattcgtctttatagaaccatgaggcagaccaatcgttctctttgaattgaggcagggcctctagacgagagattgcatcttcgtctttaaaacggatcgcatagacaccgtcagggtcaccatcttcaaatgaaatcacttcaaacttacgcccacgtaagtaggcaacaatttcgcggtttacagtcggtgcttgttcgataaaatcttgaacattcttttcttcgagttgataccatttattcagttccataatttcctcagaatgggttagatacgatagacggtgtagttttcagggtcatacgagacagagcacggataatgactacttcgtctttaggattatcgtgcagccaacgagaagcgaacccttcggcttcttctttagtacaatgatgctgacgaataagataaccaccgtcgcctacagagagcaccagacacgcgtaatcattatcagcttctacaatttcttcaaagaaacggaattcatcatcgccggtcagcaagacgcgcgagataacaggaccaccataggtgtagcccattgcttttgaatcgagaactacggtagaaccgttttcgttttcgactacaactgaagttactgaacctgcatctgtaaccttacaaaccttaaagcctttttcaagataaggagcgaaaaggcgatttcgggctgctgatgcaataaaattattcatagcttcatcatttttaaagcgatagcttttttcaacttccatttttatttcctcagtaaggagcccgaaggctcttaacgaacacgtgaccaattagacaagtcaatcacacctttagctttaatcttttcaatcaagatgttagcacgagtacgaccattttcataccatacaacatcttcactgtaaccagtttcatcatcccgataggtctcagaacgaatatgaccatatacaatagtgttcaaagcatagatttcaccagtgaagaagttctcaacagtgatatgccagcagaaatcatcagaaggaccatcaggagtcatgcagtgaaccacatcaccttgatgtttgcttaccatccactgtaactcatttacagtttgtgctttataaccatcatggtctttgcatttcactgtagctttcagattgatgattgtcattttattctccgtttgaagctttgttgttgattgagtgtacatcatatcacaatcctaggagaagtaaacaccgccatgaaaacaaaaatgggaaccactagggttcccatcaaattatactgctttcggcttaccaaaacgagaagcatcatcgcgaagaacagcacgtgcacgtcgcataatcttctcaactgtctgattgatacgagagttcgacccacgcttgtaaccagcgcgtttagaatcaccaacaactttttctactgctttctttgcttttgcttgtttagccattattaagtcttccattttggagaaatacatgggaacgtcctacgcgtacacgttgtcagttcccgcaagccctctaggggtacgtttaaactcttatctgttgcacaccgttagcttaaagggtccgggtccgatttctcgaggataagatatacaccgatggatgtataggccttgaggcgtactcccgattagccatcgcctcggggtagcatgcacttgccgtttattttcaagttcgcactttagtagcgtatcactggaggttttgacttatttaacgtcgggatgacctacaaccatgacataattacttcagagtaactacgtaatgacgaactgctttacgagccgcactgcacagtggatatgcatatttcagtacgtcttgagctgcaagagtatcacgcagatttgcctgtactggattcagatgtttgaaaccagacagaacggaaaggatttctgcgcttacatcgattgaagcaccagagttgtcatgacctgcgttatatgctttgcgctgaagttccagagcggtttgaataatagacattttatttcctcaaaatgaggttaaagattggtagagccccatcaccctcatgggatggcgcatctctaccgtatagaagaactggtcatgtccttttgtaggtagttctccagctcttcataattttatttatacaggcaaggaattgctttgtaatgacacgttacaaacttctgtttaatttctttagcctgtttgagaccaagagcaacaagaggatgtggtacattagcaattttacctacaggaagtggagttaaatcacctacttcacaaaaacctgctggaacgtcaggaccaacagaataaacggtgcacagctcagggatttcaccttgagaccgtttaccaataatcaaaccagattcagtgatttcttcatcaccagcttgttttggttcagaaaccaagataacatattcgccaacggcacgaattggaagttccattttattaccattttgttgtagtggatgtaataatattatcacacccactttaaagcaaattacttacctacaaactgcagcaggtgctcaactttcataccattaactgagatcagtttatcgatagaaaagccacgccactgtttaatatcagtatcaaaggcaggaaccatatcggtagcttctttacgaggcttactaggatttacatagctttcataaatctcttcacccaccaaatcagaaataacttgtttgtcacgagaagctttcatagtacgaatagtaccatcagccttttcaaagacaatatcagaagcacccatagccaatttggttttcagtacttcacgcagagcgattttttgttcaacagtcagtttcattttattccccaacaaagagagcatcaatacgaacacgatatgtgacagcggcaagaccaggcaccggattaatacgagaaacttcacgaacaaatacaatttcagcattttgttcaacaagctggtcgataatatatccgatatcatctaccaatcgagttttcatttcatgacgtacacgtacgccgtcaacattagatgtatgccaaaccggattcactttaattgaacgaatactataagcagccaaacgttcaataaattcatcggttatatctacttcggtcggcgctagaacaggtttttcaaaattaatcattattcaccacagaaattacggatgttttcccagttcagagaacggagattattacgctgatactcgaccacttcaattcctgcttcaagcagaatatcagcccagttgtcaggtgaacggtcataacgctctgcgtaaacgactttcttaatacccgactgagaaatagctttagtacaatccgggcaaggagaagctgtgcaatacaatgtagcaccttcaatacttgaccctttacgtgcagcaaacagaatagcattcagttctgcatgaatttcatttttagcagaccattcactatgagcggggcgatgctctttagcaagaaccataggagctttagtttcccatgcttctcgtggtttcattttcagccaaccttgactttctgcatggtcacaacagtttgttccacctgcaggagaaccattataaccagtagaaataatacggccatctttttcaattactgcgcccactttccaggaacagcattttgactcttgtgaaatgagatatgcaatctgcaaatacgtggacgctttcatttaatcaacctttttattgatgtaagacagaagttcttcagtttgttcccaactgatacaagcatcagtgatagaaacaccataagccatattgtcagaaatcttttgatttccttcatgtagattagattctatcataataccttttacgaaggcattatctgctacacaacgccccacatcaagctgatttatgtaagaacctgaagcgttagcatgactacaatcaaccattaaatatggattcaaactttgtgcagaagcattctgtaccgcgtctaaaatatgtgagctgtgatagttaggaccgtcactgccgccgcgtaatacaatatgagtattaacgttgccttttgcatgaacaatgcctacgcgtccatcctggtccattcccatataacgatgcgggaatgcagatgacaacattgcatcagtagcaaccttaacagaaccatttgtcccgttcttaaagcctacgcacatcggcagacctgaagcaatttcacggtgtgtctgactttcagttgtacgagcaccaattgcaacccaagagaaaataccggtcagatacttaatcgtgaacgggtctagaacttcggtggccagaggcagaccaagctctaacagattgacacataactcacgagcagtctcgagaccaagatgcatatcaaatgaaccgtttaattcgggatcattaataagacctttccaacctacagtcgttctaggcttttcaaaataaacacgcataaccaaaagaagatttggatattgcgcttggattttggataatctttttccatattcgagagcagctttagggtcatgaattgaacaagggcctacaacaataagtttgcgtgggtcggtgtcattcataatcgaatttacttgttcacgatgggcagcgacttgcttttcaagtgccgccgtcaaaggatatgtttcaaccaatgtttttggagaaattagtgattcgactactggtaacattattttgccttaaaatttataaacagagtgtgattcaacacggccatcacgacctagagttaaattgtaatactcttctttgtaagcaatcgtatcttttgtacccttttcaatagtaataagatacgatacaggactttcagcctgaacacggactttaacgtcattacgttgttcagagattttgttgattaatgcctgagcgaactcaggcacggcagctgcaaattcttcgatattaaattgcttatctgaaatcattagatgaaccctttagttgtcgtgccgtagtcccaatcgaattccacccagacaatataagggtcttcagcattcagatgaacttcaatataagatttgaaagaagtgtgagtaatttctacacgctcaacaaaatcgccaaatagaatattcagaacgcctgttacttcagcatgaatttttgcttcagatggattgtctaattttccacggacattattagccaaaacttgacggaatactacatcaacaacttcttgagttttagggaacattttgctttcctcaatggactgtgtgtacaactacgcgaacaacaaatgccactacagggtcgttgattggctggaactcaacatgatattcccctgcataacgcgtgtttaaatctttacgaatttctgcgatatcattaattagaccaggattaaatggcctgccttgaagcttacgaagcattttatacgcttcttgttctacttcataatgtttatcgtacattttgttttcctcatttgaccggaagtctatagtatcacaaacttccggctttgtaaacagttagaaatcgccgtggtcaacttgccaacattcaacaccgatacggcgccacatctctacgacttgtgcacggtcatcgaccgccagtttcacgtcgtaatacggggcaatatcacgccagaagatttcttctttaacaatcatgtcaccacgtgaatcgccttgttcacgctggaaatgttcggtaaatggaatgaatttatcggtaagccatttacgcgtcatcactttatatttgatttcgtcgtctttagtaccagattcacggccacttacaacgatgacagcgtacccatcacggaaataagaacgtgctaattcaaccaccattggattgatgatatctgtatcacaattctctaggtcgtaaggagaacgacctaccattttagctaatgtaccatcaacatcaaatataacagccttcggctttcctggtgttccgtcataaacaggcttgccttgatattcacagaacttccaaaacatctgtcgtaagacgtcaataggtacagcgccttcaccacgatgcaggttacgtttcaggagttcggtccacggtacatcaaatacttcttcgtgataagaccaaccttcaacaccagccagatttttaaaatcatcacggcgattttcattcaggttcgtatccgcgacaattacacctttagtagattctttggccataatagccataatctgcattttggcagtgtcagttacaatttgttcacgagccttagaatatttgtattcattacgattcgtgatacccatcaggcctacacgaatattatcacggttgacaacataccaacctggacgagtcttgcaatactcttgagcccaagtacttttaccagaaccaggacaacctatagttacaataatttgtttcatacaccaagttcctcatataattcttcgcgacaggtctttaagattttacctgtttcatatgcagcattttcatcaacatcgccaagagctgcagcggcctgcatttgaccgtggcgcttagctgcatattcgaagctacggaccagttcacgaacacgttctttctcttcatgttcttcaatgaattcaggataattacgaactgaagtcatcatacgataccaattttgaagcgtaatatagttcttttctttaaggttgataacacgtgacggcacgtcagagcctggcgcataataagtaacctgagttactacatcttgtccatcgatacgagtccaagtgtaattgaaagtcgctttcttttcaagaggcgttttcatacatgaaccgattttgagaaggtctttgagctcttggtgtttgatgccatttgcatattcagcatgagctacgaagcagttgttacgtaaagtcataatattttcctcagttgagatatccgtggagggccgaagccctcaattacattgtaataacaatacctaaagatacagcacaagcaactccggctacaaaaaggccgatacagaacagtttagcacctaatgtcattttacgcattttgtttccttcagttcagttcgataataacatatcatatcatttgagtcatgtacataccggctgatgtcatccatccaagaccgatatttctgagagtcttcaaaactcataccaacccaggccttaccatcaataacttttacttcccatttgctatcataagccttaatagggtctggccatgatgggtgcaatttttcaaccttagtgggctcagggagcttctgggcgcatcctaccgctaggagagataaacatacagccgcgacttttaaattcatctcgtcgcctcctggagaccctgagcaaacttattgaagcttgcgttaatctgattttcaactaacccaggcttcttggccactacatcagctcgctttgaatctttatcaagcttttggtcagatttaacctggtcttgacgacgttcactacgattcttatcaatgttctgaagacctttaaagtcttgttgcagagttttaatttgctctgcctgggcgttggccgtttgtgttaccgtattaaggtctgcttgaagcgactcaatacgtaagttctgaacaaataggccagctccagctaatgctgcaataatgaccattgttccccagatatttacttgcataactttttgataacctctacgatatcgtcacgtgacaggccattcaccagaacatgcttagcagattcggattgaactttatggctgttatcaatcagagcagcaacttcatcagaagtcagagtgctgtgagcgatgccgagacgattaaatttgtcagtcagtgggtcacaaataatatagaacttatgcccattgatgtgaacatttggttggctgatgttaacgaacacttcagcatcaggcaggttgttggctaagaactcgaccatattatcaaccgcctgtggcattgcttcacgacgctcttcggtttgcttagtactataagccttctgtttaactttctgagaaagcttgcgacccagagtcaggcgaagatcagtcaagaaaccaattttcttagagcctttatagacataaatcccgtcatgacggtcgccgaattcttctacaactgcttcattagtaatagcttgtaagttcatcgtgaatccccattttgttagtgtaggagcatcttaacacaacaaaatgggattgtaaactactcgccgaaaataatttcttctttactatattctgcaggcacatgtttcttgcagttcttcatgaagaccttaccgagctgttcagggagagcatcaaaatcgaggcctttctggaaagcattcatcaagatgctgaacaggccaggttgttctttaagttcaacttgtgctttcatagcaaagtctttacggtccaacccgaccaatttgttgttcaggtcgacaatagtagaaagagatttgcccagccaagacagataaaccttttcgaacgcttcaactttattgaacgcgtactcatcgcctgcaaacatagatttcaagtcatcagatgcattagctacgatagaactaaacaagcgctcgttattgttgattgaatctttagtatggtgaagtgcacaataccattcggttttaagcttgaatttcagcccatcttccaattcaaagatgaagccttcgatgccttccatcttacgaatttcatttatgaaatcaggattgctggtatcgatatcaaagccacgaaccaagtattgacgaagaatgccgtctttgaacagttctttatatggcacgtattcaccagtatcattatgacgaacgttcagaagaatgagggccttttcttgataatcaagaacaatacgattatctggtgcaacatactctaagttagcagtataaccatctttagccagctctaagaggcgctcacggaaagcatcattctcagaacgataaatccactgcagtgctgcatcagattggtcagagtaaatagagcctttagatttgacacgcaggcgcccagcatcgacaaatgtagaaatcagagacccatcttctttagccgttactaaagaaaccttactgaaatccaggttcatagtaaatggagtttcgttcaggttaaagaacttttccataggacgagaagcaatacgaacaggaccattctcatcaatttcaaacataatgccacgacattctaatgcatcatcaaggcaccaatcagtgtaagaagcaaagttgtaactaaaaattctaaattgggtaccgaaaggagaagtgaagtccttgtagaagaacttcattttatcacaagtctggcacaattccattaagttgtcgaataattctttcatcatttagccttatgttgggtgttccatggaggattgaagagcttgatgaacattggctcctctaaatctgtagtggagacggacatcgtgccaagctcatttgtcattgataggttaaagcactggcgtgcatagaactctaccttcttaccagatattaacgcatcgtatatagcagcagatttgattgaatcactgttttgatttgtgcgattaatgctggttctgtaataatttatacgtttgcgcaagttcttagtcttgcctatgtacatcagttcatcatcgactgaaatagcatatatgacgttttgcttattcggtaccgtaagagtcttgatagtgcaatcgtcgttgagctctaatgtaacatactttatgaagctgtattcatttgctaatttcatactaaagtagggccgaagccctatccttaaagataaacacggaagccgttaagtacgtccgcatcgacatcattatcaatttgtgcaacaagataagaagagatttctacttcttgaggtgcagcctgtacaaggtccgagttcagatattcacgaatccaagggataggatgtcgtgttgactcaagtacaatatcacaaggaaggccagcagctttcattctgcttacagtcagataatcgatgaactggtgaagaatttcaacgttaagacctggaagaccaccattacggaacaggtgaatagcccattctttttcttgacggtttacttccatgaagatttctactgcttcacgttcgcattctttagcaatttggacccactcgtcaccatcagtacccatttgaagttgacggatgatatattgagtagatttaagatgaagctgttcatcgcgtgcaatgaacttcataatcttgctgttaccttccatgatttccatgttcttatggaagttgaaggtacaagcgaatgaaacgtagaaacgaattgcttccagagcgttgatagaatgcaggcacagataaagagccttcatcaggtcatgcttacacccggcttcatgttcaacagcatctaaaaacagctcatcagaatgttcagacgcttcataaaaatcaacatctgctttagcattctgccaatgacgagttttttccagaacatcatcatataaacgaccgatagattctgcacgagccataatagcttcatcaagaataatctcatcgaagattttagcagggtctgcgaacaagttacgcatgatatgtgtataagagcgactatggatggtctcagagaacgtccaagtagcaacccatgtatctaatgccgggtctgaaattaatgccatcagggccgctgaaggggctctgccttgaatagaatcaagcagcgattgatactttaggttagaaatgaaaatatcttgttgatgatctgcgagtttatcaaactgagctttgtcagtcatcaggttaacttcttcaggacgccagaaaaatgaaagctgcttttcagtgagctcttcgaattgtttatggcgttggatatcataacgagcaataccaagacccgaaccgaagaacattggttcattcatgatatcaacttgctctttattaaaaactgtactcatttaacttcctcaaattcaaattcaacttctacgtgagcaattgcttcagcacctaaacgataaccttcaagatacattactatgccataatcatcgccattaactgttggtggaacttcggtcagtaaagtacgaacaacgaattctttcatttgttcgccgttattataaacggcatagacatcataactttttgcttctgttttgtggctcattttatttcctcaaagggctcatccatgagccaattatattacaatttacaagcagcgcaatcgtcagctttagggccttcgatttcataatcatcggtaccagaaccatcacgagtgttgtgataataagcagtcttaccaccgagtgaccagaagtaaagcatatcacgcatcatgactgacatctcaaccttacctttagggaaattctgagggtcataatcaaagtttgtagaaattgattgacatacgaatttctgcataattgccgcctgagtcaggtagccacgcataccacgtttagtcatctgccacagataatcataaagctcaaggttatcttcaaccttcggaactacttggttaaatgaaccttctttagattctttaacacttacaggtccgcgtgggggctcaatcccattcgtagagttcgatacttgactgcttgattcacaaggcatgagagctgacaaagtggagttacggataccgtgtaatttaaggtcttctcgcaactgttcccagtcacatacatagttcggcgctgcgacgttgtcaatctttttattgtaccagtcgataggtaattcgcctcgagaccaacgagtgtctgaataatattcgcaatggcctttttcttttgcgagtttaacagatgctgtgataagtccatattgtaacctttcaaacaattcatgagttaaatcattggcatcatcatatgtggcaaagttattagccaagaacccggcatagttcgttacaccaacacctaatgcacgacgctttttagctttcagtgcttcttcgaccggataatcctgataatcaagtaggttgtcaagagcacgtaccattacttcagagagttcgtttaccatgtcctggtcttgataatcaaagctatccagaacaaatgccgctagcgtacacagagcgatctcagggtcatcactaccaacatctttagtaggcagagcgatttcacagcacaggttactttgttttaccgtagcaatgtcacgaataaatggaccatggtcaccaacgttatcaacgaaataaggataaattcgtgctgtaccagaacgttcagtgaagaatgtttcgaacagctcgagagccttaatacgtttcttacgaacggtagggtctttttctaattgttcgtataattcacggaactcgtctgcatttttgaaataactttcatacagagcaccagccataatttcaggactgaacaatgtgatgtaatcatttttaatcagacgttcgatcatcaagtcgttaatctgaataccatagtctaagtgacgaatacggttttcatctacgcctttgttgttcttaagtacgaggaggttttcaacttcaagatgccaaatagggtaataaagagtcgcggcaccaccacgaactccgccttgggaacaggatttaactgcagtttggaagtgcttccaaaatgggataacgccggtatgtttgacttcaccatgaccaatctttgaaccttctgcacgaatcatgcctgcgttaataccgataccggcacgcttgctgatatatttgatgatgctgttagccgctttgttaattgaattcagtgaatcaccaccttcaataacaacacaactactaaactgacgagtaggagtacgaacgcctgccataataggagttggcaaagaaatctgacgttgacttactgcatcatagaaacgaagaacgtgcttaatacgctcgtttggttcgtcttggtgcagacacataccaataagcataaatgcaaactgaggtgtttcatatactttaccagttgaacgatttttgaccaggtatttttctttcagttgcatcgttccagcataagtgagttcgaagtcacggttgtggtcgatacgagattcaagatatgcgatttcttcggctgaccatttctgaaggatttctttatcataaagaccttcattgacaacacgagaaatatggtcaataaatgacggtggttcgaattgcccgtacacgtccttacgtaacgcgaacatagccagattagaagcaacatactggaaatcaggctcctgaacagagattgcgttggctgctactttgataatagcggtttggatatcacgagtgctcataccatcttgtaggtatggcttcacacgttcatataaatcgtatgggtcgatgttagtattttttgtagcccaatccagaacttggatgattttatttggttcaaacagcgttgcaataccgctggactttactacttgcattataagtcctctaatgaaaatgtgtctttaaaaagtttattcaccacttcagctattatatcaccatgacatggcttaggtttacatgtgcatcctaatctcattccacgcaatggttctagatgggctctagtgatttctccgtttcggagtttattataaaaatcctgtttaaatgcaagaatggcagcctctcgactgccagcatctttacctacataattaccccagaacgttcctcgatggatatttacatcgaagtcggactggtatttattcacaacccgacacgctcttttcattatacggccatcttcgctttaatagtagggtggctttcgtaaccaatgagtttgaaattagaatggtccatcatttcagtaacccacatcaattgagcatgagtaggctggtcaacaaagttagatggtagacctgtaatttcaagttggcacatctgcttaggctcacgacgcagaacttcttggcactgttcgatatgattcgaatagatgtgtgtattgccgcctgagaacacgaggtcgcctggaataagattacacatcttcgctacgatatgcaacagggcggcgtaggaggcgatattaaatggtaatcctaagaacacatccactgaacgctgataccattgtaggtcaagatgaccattacgcacgttgaactgatagaacatatgacaaggaggcaaagccatacggtcaatttcagcagggttccacgcagaaacaatctgacgacggtcattaggcagagctttaatacgatcgatgattttgactacctggtccacgccaccgaaatcgcgccattgtttgccatacactgggcccagttcgccaccagaatagccaagatctttcgcctggttttcatagttttcgtcccaaatagttttaccttcgattaatgaaccatgagtacgccaacgcagttcattaacatttgtgcttccagacaagaaccatagcaattcagcaatacaagccttccatgctaatttcttagtcgttacagcagggaatccttgagtaaggtcccaacgggccttcgtcccgaatactgcaattgttccagttccagtacggtcatcagtttcataaccggttgtaagaatatgttgaatcagttcttgatattgtttcacaggctcatccaatggtctttaatataaatttcgtatttaggtttatacccaagcttaatcatttcttttgctttacgggtaaacccgagtgaacgttcacctttacgttgctgtttttccgtcatactgccttgatgaatctgacgacaaatatacaacgtcatcgcatcaggcacaccattaactttcagtttattactcattctgcacctaatataaagagaatttcactgcctcgtttatcgaatctacctctcatagatacgatatcttcattataccatagattttgtgcagcaatttgtttcaacaattcgacatggctacacaagactttaacggtacgtccttgagaatgcctgtatccgtccagccaaagacgcatgccattatcatggctttgaatgtgtttaatatcacaatcaatttcgtacagaccgtgaggaatagtattgaacaaatgtgggttacgtttgtacccatcaatagtcggaactggcccttgaattaccaaggcccatttcttttggacaggatctgcatcaataaggcgaatcataatgaacctctgtttcaggaatgaagtagaacttagtgccttgtttttcgaagtggccaataatagtcacatacgggtcgtcgaacgtgatattaccttcacgcatggcttcaatccatgttttcgtgcaacgagtcagatgagttgtgaactgcttaaatgggccaaactcaccatgaatatagttagcgttagttgagaacaggctaactttaatatccgccagaggcagatgaagagcatagattcctttatcgaactgaggaccctgccatttaggttgtttctggaacttttcgattagataggcttgatacataattccctcggcttataaactgattcaacgatttgggtaagttcatcacactgataccagtgagtttcggtcactttatactgtgcacgaagattaaacattgtttcttcgctcatctggacatcagaattcacacgatgatctttaatgatgctagtatgtacgacctggtcaaccctggtaatcgcctgctcaattaaacctttaccgccaatgatacttacattgtcagtgttccggttcactacggtgtcccagggatattccttagtggccgtagagacgataatattttcgccatttaagaagcgttcgaactcttcaggagacatgacttcagacggataagtaccatctttagtttgaggcttaccacgctgaagattacatacaacaatagaacggcggccaggaagaggcttctgaaaactctcccaggttttagcacccataatcataatcgtattatcggtacgtgctttaaagtttttcaggtcttgagggatacgcccccacggcagaccattatttagaccgaaagcaatttcagatttaccttcgatagtttttgtattacaagttgcgaatactaattggagcatttttcttcccaccattcaagcgcagagatttcagatttaaagatttcaccatcaatatatttcataccatcatcagcataaatggttactgcaatccatggatattgacattcgatggaactattttctaatgcattttcaaaatgctctttagcaatatctgctgatttaacactgaatgctgtttgaagattatattcacccttttcatcttggtattcaactacagtaatcattaacgtacctcgatataagctacggcagaaggagcaacatacatacccatttcgtcacaagggtcaccaagaacaaagcgataattgttaccgcggccttggaaccaggctagttggactgtgtgcatttcgccataaattgtttcaattaagaaaggcttatcatatgctatgtttgaataaagcgtatccaaacagaattccggtccaattttgaccagcttgatgtctttgtattcgagttccattaaccctgcctcatcccacatttaaaacatttaccgccaagactccatagtccagcgccgcaatacttacattcccagtcacttagaatccgcatgatttgtagccactcgctttaaccatatcacgaagaactttgaagccttgttcgacagcaccagccacttcttcaaagaccgatttctttagaatgaaaagtgaaccactggctgttttattgccaatgcagttgttgattacctggtcatccagagggaagtcaccataagcggtttcaaccttaccaaccacttgattaccacgtgaatgtgggtcaaatgccatatgaatgtatgatactccaggaatagtatcaaactggcaacgaactttaatcgtcgggtaacctgttacatgaatatcagccatttttcttcgcctttttccaagctgctttaaattcttcaacgtcttcaacgtgaatccagaatcctgaaccgaagccatcttcatagcaagggcaaccatcacagtaacgatcccaagtaactacttcagaaccgatagtatggttgcattcgattgcacgaagacgatcttcagcagcttcaagagcttcaggattatcatcatgaatatagaacaaccacttaccacgattttcagaaccaagtttaatgctttcacgttgaagtttcattttaatctccttgttggtgtagaagcataataacacgcctctacaccaatgtaaactatttctttaaagcttctttaaaagcttcaagagatacagtatcggccggggtcagatacacataattgaatacacgaccgtcaagcccaaagacttctacacacaggttgtagtagtcgctttcaaccagatgcatggctttaggctcatgaattcggtcaaacagctggacaacatttgtaccagcccagatgttgttacgaccatcataatcaaaatcttcaatcagaacataaatcattttgcctccagagccataatttctttgaagtagttagcgtgcaactcacgattggcttcaaagaagaagtcatcattgaaatcaatcagagaatcaaaatcgccttccagaaccatcagggtgcatacactaatcagtttttctgatacgatggtaactttagatttagcagcgatttcacgggccagttcaacattcttaactacaacttccagttttaaagttttcatttcatttctccgtttacttcattttgttggtgtaggagtatagtaacattctcctacaccggtgtaaactacttgttgaaaacttttttgatcaattcaatcatttcttcagcgttattagaatctacttccaatttaagctcaagaacaccacgtgaagcaccgtcaggcttgacttcttcaaagaattcaaattccaagttagagatttcgaagtattcatcgccttcaccgtcagcgctaaattcttcaccatttgccatacgaactttggttacataacgcccacaatcctctttattaattactaaaactgtaaacgagccaccgttctcatcgatagattcgagcatattttcgttgcatgagttttcgtcaacaaactgctcacgtttgctagggataatgcggtatactttgccttctttcattttcattcctcaatgctttcaagggtttcggctttcagttcttcgtccatacccaccatatactcattgtggaggtaatgttcgataacagaacgttcgccttcgatagtgatttctgaactgcaaccatgaacagattcacctacttctttcagattgtaacggtcgagacaagtctcttggaagtaagcataatcatagatgtcgatagtaatacgagccatttttaaatctccggtttgttggtgtatgagtatagtaacctgttttgaaagcgttgtaaacacctttgttcaaaaacccctaatggaacatataagttactttatccgcaaaaagtggacttaacgtaacttatatgttccataaacgaaaaatgggaaccataacggttcccattcattattacagaccagctaacaggtcgtcaagaccatcgtcatcaccaccagcttgaacaccggtatcgactgaatcttgtttcggaggtttagactcgaactgtttcatttcttcatcaaaaccgtccagctcatcagcacgctgttcagctttagcggctgcagctgctgcaccaccacccagagcggcagtacccattaccttagcaaatttcttctggttgtcttcgaaagacttaaatttagccagctcttgcaggtcacccatgtcgtccatcaatttcttctgaacagcttcgtcatcgatacctggaatttctgactggttcaggaatttggagtcatcgtagtttttgaaaccaccgaccattttgcatttcagtgcaaagttagcaccttcatagacacaagtcacgtcaatcggagtttcaccaatctcagtatcgacttcaaccatctggttaattttgtccatgattttctgaccgaaacgatatttgaatactttaccttcgttagcaggaacagccgggtctttaacaaccagaatgttagcccagaaagaagttttacgtttcagcagtttgtattcttcaggattactattgaatgaatcgttcttagtcaagtgttggcacactgggcaagaatcgaaatcaccgtgagtagaagtacacgtttcaatataccattgaccatttttcttaaagccgtggtttaccagcttcaggaatggagatggattttcttcattcttagaaggcaggaagcgaattactgcggaaccaacaccatcagtatctttcagtttccactcatttttgtcgtcatcataggagcctttgccacctttcattgcagacagttgagcttggagttgtgcagggtctttacgcttaaacatatattattaccttatttacaattaacagttttatttacatttgagagtttattttaacactattcgaattcagcaataaatcgttgaaattcgatatcagaacgaggattccatcctgatttaaatctatttatcattgtaataccagtcatatgcgggcaatctaaaccggtttcacgagacattatcttcggacctaatctagaagttttatgagggcctacataccaatcataaaagatttcggcgttacgccatacgagatgagcacctttagcaaccgtattaggatgttcccatggttgtttacctttaaggtgagaactcgatttcattttcttaatatggtctttagacttaggtttgcctttcaagcatgatttaaaagttcctttagccgaggccttattaaaaaataagggtgatttaaccacatcataatgaatatggtaaagctcctcttcagacaagacatcttcgcatacatgaagtatcttaactgtagggcgctcatttaaagcggcaacaaatcttggctgtttacaagacgaccagtattctttactatgtgaatcaattataacaccattttcgaataagcaattatgcttagacccaatataaaaatatggaggtgttttatctttcatacgttggttaaaagtgaaccaatatacaatgttcaatacttacaacctttgatggtttcaataaacaacttacgagcttcatccttatcgataatcaatatcttacggtaagcctcaagtttagtcgaatacttggaccaaaccaggtcatttgttgcctcgttatgtttatcaacaataccaaggaaactatctaatagaaggaatgtttcgaatgaaatcacattcgattggaggagtttaaagatatagctcgattgaactttattattatactcaaatatttctgacagcgcttttacttcaaccttttggctaaagtaatagatgtttttgatgtcatctttaaattgttcttttatacgtttcagacgaccgatatattcacggtagaaaacgagggcgtcagcatcactgatgtcgccaatccatgcatcttggttagccaccaagttagacatgaaaatgagcgtgagctctttcaaagtgtatttatcacttaatttttcgaagaaatatttgtcacgtcgtttttgatacgcagcgtcagagactcgcatgacccaattgtacttaacaacatcgtagcgcccattaaagtgctgtttgatggctaagtacaaagtgtagacactcttgccattgaccatgcgattgttgttagcgggcatgcgaattttaatcataacaagaagtccagcgtatttgttttctgagtacgactaaatgaaggacgaagcatatggtcatcaatggcttcgtttttaattttatcaattataccctgtgggatgtatttagcaaacaacccttctgggattgaattttcttcaaggaataaagttgtcgcttcaagatagcctaattcacccttggcgacgatagcttcaatagcgaacgcattctgttgtttatctaaacaaacatcaagcggttcaacaggggcttgtacagccccatcaaaatcagttgtcgaagactgcgtcatataattccaccacttcggttttttcatcttcaaaacgttcacgagtgcctttatgatacagggcaaacagctgattgaactttttactatctacaccaagttcatctttagctttggtacgaagttcagcgacttcacccatatagccttcggctttcagtttagcatctgatgcagatttaaccagtttggcgagctcttcgccatgagtatcaggacaaaattcaactttcacttttttagcttctttagccattatattcaccttaatagaagtcctgcacgtgggcagttaatttagaaagaccagacttaacaaagtaaggatatacttttgatttagccggcacctgataattattataacgttccatgattaaagcaacaatatcatcagggatagaatccatatcgatgaggagttggttttctttgaaacgtttgaactgttcttcagtcagaagtttttccatcgcttcgtcatcataataattcaaagcgaaggcatcaagttcttttgctgaagtagatggggtacgttcgccatcgacacgagtcaaccagaaattgccgcgaactttaatgcttgcaacgttatctttcttatcgcctttaattactttagtaacacaatccataagtgcatcaccggatttggttttgacccatttcttctgcataggagaccattgcttaacaccgggatatttgtgaagctgtgtaaagtcaccatccgatgaaacgattacacatgggtgtcctaaagatgtaagatgtttgataagcacagcgatatggtcatccgcttcaaccttatcaatattcattacaatataaggcatatatttttcaagttcttcaatgatgatatgcattgcattgaagaggccttcccagtcgaacggtgaatcttcacggtcaactttacggtttttcttgtaataagaagaataatcacgacgccagtagccagatttactattatcgacacaaactacaagattttgatagccttgtttcttgaagtcttttttgtttttcttgagcgagttcagaaccagatgacgaagcatcgcagtggtcactcgaggatattttgccgcttcaccaaattcggtaaaagcggctgccatgataatctggctgaagtctaggaaggcgaatccttccttttcacgttcatcttcagggagtaaaaaatctaattcatttaaagccatatgaacctctgttcagttagtttactcgtctatagtaacacatccatgggcagcaataaatagaattattacatcaaatgataaaggaaacactatggccgatttactgaaacctgcattccgtgccacatctggtctcgacgctgcaggtgaaaaagttatcaacgtagccaaggccgacttcaatgtacttgatgacggcgtgaacgttgaattcttcattgaagaaaacacaatccaacagtatgaccctacgcgcgggtataagaaaaatttcgctgttatctatgacaaccgtatctggacttcagttcaggcaattccagctccggcgggcgctttcgtagagctctattggaaagccgttcgtaccgaccctaaatgggtagaaatcgtccagccaactcattcacttaaatcaggtgaatacgttactatcaacagtgacgaccgtgcatgtacgttatctttaccgtcaaacccacaagatggcgatacgattgtagttaaagacatcggtactaatgccggttatcttgagcagaaaattcgtgctactaatcaatatatcgttcgtaatggcgttcaggttcaagaaactattttaactaaacgcaactcgtataatattctgatttattcagaacgtttatggcagatgtatgaaactgcaaatgaagaaaaggccatcagaattgtacctggttctcctgttcgtattcttgcaggcgatttaattgctcgtagatatcctactgcaggtgcagttcaattaattcttcctaagtttgcgaatgacggtgatttcatcagaactgttgacgttgatggaatgggttctgtatatcatttaataattagcacttttgataacacatcatcaattggcaaagctggtacgacttctatggaattccgtacttcaggccatggtatgctgatttattctgctgctgacaaattatggcgagtttgggacgctgatttacgaacccgtcttcgtattatcagagataacgttaagcttctgcctaacgaatcggttatcgtctttggtgaaaataacagtaacgtccagactattactcttgatatgcctacagatgtagctatcggtgatactgttaagattgcactgaattatcttcgtaaaaaccagacagcagttattcgtgttgcacaaggttctaccgataaaattttaaccgatatcaaactgcttcagttccctaaacgttcagagtatccacctgatgcgacttgggtttctgtatcttcattgactttcaatggtgatatcagttatactccggtaattgaattcagctataccgaagataatggtgtaggtgtttgggttattgcccagaacgttcctactgtagaacgtgtagacccattaaatgatgcgactcgtaaacgtcttggtgtaattgctctggcaagccaggctgaagccaacgttgatagagaaaacaaccctgttaaagaacaggcaattactcctgaaactttagctaaccgtgttgctactgaagcacgccgtggtattgctcgtattgctaccacagcacaagtaaatcagattactgaatttgcgttccaagacgacctcattatttctcctaagaaattaaatgagaagcaagcgactgaaacaatgcgtggccttgctgaaattgcaactcaggttgaaactgatgctggtacagatgatgcacgtatcgttactcctaaaaagcttaatgatcgtaaagcaactgaatcattaactggtattgctaaacttgtttctactgtaggtactgcaaaaggttcttctagagccgtaatgggaaccaacgtttacaataaaaacaataatactgatattgttactcctaaatctttgaatcagttgaaaggtgaatatgaagaccaaggtctgttctattctgctaccgaagctgaagttatttctgggacagtaactgcaggatttgaaaacgttgctgtaacgcctattgaattgcataagaaaactgctactgaaggaaggattggtttctctgaaattgctacgcaagtcgagaccgacgctggtactgatgatttccgtttcattactcctaaaaagcttaatgatcgtaaagcaactcaaactcttactggtattgctcgtattgcaactcaaacagaatttgatgctggtacattagataacgttatttcaactccgttgaaaattaaaactagatttaatgatactgctagaacatctgttatcccggccagtggtttagtagaaacagggaccttatgggaccattatacacttgatatcaaggaagcaagtgagacccaacgtggtacactgaaattatcaacccaggtattaaccgatgctggtgtagatgatacaactgctgtaactccactgaaacttcagaagaaaaaagcgactgaaagtaccgaaggtattatccaaatcgctactcaggcagaaactgttgctgggaccgtaggcaataaagctgtagttcctgttcatctgaaatatgtggtccaacaggaaaaatcttgggaagcaactcctttacgtcgtggctttgttaaaatgactgaaggtcctttaacttgggctggtgataatgttaaaggttctattgaaaaccaagaaacattcttgaaagatggttatgctgtttctccatacgaaatgaacttggctctgtctcattatcttccaattagcgctaaggctgttgattcggataaattagacggcctggattcactccagttcatccgtcgtgacgtagaccaaaccattaatggtgttatgaccttcaagaaggacgtaatcctagaagcccctctgctctctacaagcactgcagattttgctggtactttagaagctaatggattaacctctactaatggtgatttcgctattgtaaatggaactaacaaatggaaattcactgctgggttaaatggaactacattagtaattggtgatacgactaacgtcttgaccatgaatacggcctccggaaacgtagctgtattgaataatgtttctgctggtaataatgtttccgctaagacttcttatattctgaatagccgtgaagttattacaagcaattcttctaacgtagttattggtgatgcaactaatggtatgtccttacgttctaaagatgcaggtaatatcattgcggttgatgatactccattaggaagccaataccgtgtcttgactgaaaagaacgttaaagaaattgttgaccgtgatttcgttaagaaatccggtgatactatgggtggtaaattaactgttgaagctccagttctcccacagatttctgaagctaaagctatggctccattaaccgttgatacagtaggtttctggatggctaatattactactccatcggtataccaacaattaccaggttatgctattcctgaatttgctactaatgaccaaggtaacccttacgttgattcttatacgtataagcctgctcctggtctgatgacttgttctggtgtttcaatcgacaatatctatcgtacttggactcctcgtccggttggtgttgctgataacgaaaacgcccttactcagtacatcagtatttgggacgttgctcgtggtgtatggggcgaatggtctcgtgtgttaacttctcagttaccaccgactccatcagaaattggtgctgttgcttcttcaggttcagcgttcaacaacttgagaattcgtgattggttgcaaattggtaacgttcgtatagagccagaccaagcaacgcagaccgttaaattcacttggattccataagaggtaatatggaaaaatatatggctggctttggacagggatttgtccaagccactattctatctgaaaataatgcggtgaaataccgcattagtgcttctggaagttgcactaaaagtacagtccgtccttacataaaagtccaggaccagcctatttctatattagtgcgtcctgggcttaatgtttacattttcaatacaactactttagctattgaagaaaccaaaaactatatgtttacaaaggaagcatcttctagtaacgaggcctttataacatatatggattctcttccggttggaaagctggctataatgttgtctgaaggaaagcttgatactgatgatactttgatttcatggtttaaatctaaaaattctacggcatggccttctaaattcgatgttactaatttcgatgcggcctatacggcgttctacgcgacgtctaaggcaagtatcacgtcagagcatgtaatattcaacgatggggttaaaaatgaacctatagagcccctgattgacgtagtgtatgattattactccgatataggagccaccggttttcctaagagaatatttgaatttgccgaagaagcaaggcctgctgaaaccagtctggcaataattaggcttcctactacagacttgcagacgccattatcggattataatcttaaaagtggtgatgtggtttactttaaattgcaacttcttatagatacgactgacccatcaggaatcccaactggaactactcgtgcatcagttagattttttaatgagacaactttagttagtgatactactatagaagccaacatattaaatttaggcgaatggcaattattcgaaagggatataactattccagaaggagccacaggctttacggtatatgtgtctcgtcagagtacaaatgatattgctgctgccagaaatttagttatgactgaaacttctagataccgttatcctttgatgcgtgcatcggaatttggtgtcaatggtatcagaaacaacgtattgatggaagatgtcccaaacgatgagcttcttatccttaagaatacagatgccgatgaccgtggcattgttcgaagtgcagagtttcgtgaggtataagggcttcggcccttttttggtataaatacggctatactttaaggagaacactatggccgatttaaaagctggcactactataggtggagctattgcctggcaccaaggcaattttcctctaaaagcagttacagatgatgtctattacaaagactataaaatatatacaacttataataaacctcaggctatagataacgacttcgtttctaaagctcaaggcggtgcttatttaaaacctgtcgactttatcgaaggattaaatatacttgataaagcaggttataaaataaaattcggaataaacaatgctggctcaacgcctatgcatgcttattccgcttctattagaattaaagattcacttgcaatcgaaactgattcgggccaaccatttattttatttgatcctagtactgatatggcaaaagccagattaacagtaatggggaatattttagcaagatatattaatgacgagagtggacgtgtattctctccagggaaccctcctactccaactgatgtatcacttggtaatgtcacgaacgacgctcaggttaaggtagccttcacaggattgcaaactatggcgggtcctttggcttcacctaatttaatttcgttgaacccggcttctttgccagaacatgtgcctcgtctttctcaggtcattgttaagggtacaattatcgactttggaactttctaagaaggttatatggcagatttaaaacaaatacaatttaagcgctctaaaacagcaggcgctaaaccaacaacggctcaaatcgctgaaggcgaactggctattaacctgaaagaccgtactatttttactaatgatggtacccagattatagaccttggctttgctaaaggtggccagattgatggtaatgtgactcaggtaggcaattatactcagaccggtaattttagcactactggtgatattattgctgaaaggggtgtaatccgaactcgtgctgcggcttcaggcaacgctaatttatggtttgaaggcgaagaagtaactggcgaaaaccgtaataaagaacgaggcgttttatatgctacccaacaaacagataccgacgggcgagtaaaccttcgagtttataatggtaaatcccacgcggctaatacaaataacgcactgtttgtgtttaacggggccggggatttcgcggctccaagagatttatacgctcaacgctctcgtttaagtaatgagtctattgctcctacgatgaatacttcacgactttatacaagaaatagagcgtttaacgagtttggcaccaaccaaagctacggctgggacgatactgtaaattataccgctggtcagaatggagccattgctctgaactatgtttataagggcagggctcacgcattaggaacaatttggcaccagctaattgatgagcgtgatggtgccaattgggctatttatactggttcaggccctgaacgcaaaatgtttaatatacgttcagccggttcactcggccacgcgcaatttacaggaagtttgttcttagggtctggtggcggtggattgggtgttatttctggaatgggtgaaggttctttggcattaggtgataacgataccggattcagaaatgatggcgatggtgcgtttagcgtaatggctaattctcgtgagttaattaattacagctcatcagctgtcaaattccaaattgaacatagaaaggcaacaagaattactcacactgacaactcaaatactgcaattttaccagctaataatacttcaattcttgaggttgatacttcagtagatggtaataatgcaggtggtaatggattaactctcttaggttatgtgtctagtggaaggtattaccattattttcgtggtactggtagtgcaaactttgatatggatagtggggttagtattagtaaaggcggactgactgtttccgggaatagtacattttccaatactgtgtctgcgccgcgttttgatgcattaggtgatattgcatttaaaaatacagtgaatcgtcatattcgttttgaatatacaaattcatccggtacaactgcagtagatggttatatttttaaagatggacctagcaatacttccagacgtcctggtattcgtgttaactgcatggctcctaattccagttcaggttcaggtgattttgtatttggcgaagatggacattttactgttccaagacaagttcaaccaggcgattttggtaactttgattcacgttatcagaatttgttccagcttggtgcaaacgtaaacttagatacgctaactggtgacagccaaattggtgaatatgctcagcacgctaatgctaatacttctttggcattaaattatcctgaagcacaagctggtcatttaactattacttccggcgccggtgttcaacagacatatcgtgtgtataactctagccgtatgtatcttcgtgctaaatattctacttcagcttggactccttgggaccgagttgtaacagatgattatttagcctctggcgttggcggttctatagtttctaaagcagcagatggtttccgtattgcatatggtagctacgggttctttatccgtaacgatggtggcactacttatttcttgttgaccaactccggcgaccaaatggggacttggaacaaccttcgtccattaacaataaataacggaacaggccaagtttctataggcactcctttagttgtaactcattattcaggtctcacagttactagtacagcaggcgatgctatctcttggggtaacgcaggcgcttgtctggcaaacgatggtaacttaaaaggctcgcgttggaaaccctttggtggttctgaatgggctggcgatgctttaagctgggttaacaacaataatgttgccaaagcaggcgatactatgacaggtacattaaccttaaataacggtcaacttgtacttaatggtggctcaggtaatattagttttactaaagcaggtgccaacccgcgcagtatgcgcattttcttggccggtgatgctagtcgtggaaaccgtattgaactggccgatgattcatcttatttggtttattttgaacgccatcctacttctggcgtccaattgatgatgaacggtaatggcaactttgctaacgtttatatccgttctgatattcgtttaaaacgtaactttaagaaaattgaaaatgctgtcgataaggtagataaacttaatggttatatttacgaaaaaacagataagataggtggaactgaatttaaagttgaagctggtattatagctcaagaattaaaagaagttttacctgaagcagtcgaagcggtgtctatggataacggtgaagaaacattaactgtttcatctgctgcaactattgctctgctggttaacgctatcaaagagcttaaggctcgtgttgaatatcttgaatcaaaataatatagggccttcgggcccttgaggaaataatatggcaattgtaggtgttcctggttggattggtgagtccgcagcccaagaaacaggacaacgatggatgttacaggcaggacaagaagtaaggcttacagctccgttctggatgtctgctatggctgggctctctaaagaaataactataactttaggtgctaaccacaactatgacagaaacgacttgattaataaacttcgtgcattgggttctactccagcagttgttgtaatttcaggtgatttggtagcacaaagtacaggggttccttgtcttgaattcccatctaacttgcctaatgaatatgttattcttagaaataatgctacaatttatgggcgaggcggcgctggtaatagtaatggggaaacttcgggacatccaggtggcccaggtattttaaacagtttcggtactcgtcttcgtattgaaaataatggttctatctgtggtggtggtggcggcggtggcggtggcgctagaccaggaaagaacgtagtttctgctggttctggcgggcgtccattcggtccagccggtatagcaggtggacgagattctaaagatggatacgctgctacattaactgcaccaggtgcaactccaccaaaaacccgttatgggactactggcggcgctggtggtgatgtaggacgtcctggtgcacctggtacaaacgatggcggtaacattaccaactatccaggtggcgcggccggtgcagctctttatggaagtgctcctacttggacacgagttggcaatatttacggctcacgtttataaataaagtaaacaaaggagaaacttatggccatgccaagtatttccattgtagacttagtatttggcgtgcttgaccgactctttaaagatacaacgggtaaagttccttttacccgtattctttccgttatactattatttgttatggccgttatttggtacaaaggctctgagctaatgaccatttataaggaatctcgttacgaagtttattctgctatgcagcaaaagattggtgacgaaaagtttgataagactgttcgcgaacaagtccaaatagttcatgtctccagtggagcagattttacagcagtatatgcatttcgaccggtaaacaaaaacttttttgttgacatggtcgcttatgaaggcgttctaccatctagtgtgaacgaacttaacttaggcgggtatccaattgacaaatcgtcagctgaatatattagacatgtaaatggggaatattttagttcaaatacagaatcaatcttccttccaaccaaaaagaaaactgattttaacttcatgttttcttgtccctacttcaatctggacaataattatgctggaaacatcagtttgatgtggtataatgatgttcccagatatagtaatgaaaggttgcaagctatttgtgcgccagcagcccgtctgataggtcgttcacgttagaaattggaggcatacatcattaagtaacggtgtatgtcttcatacccttcgttgaattgctcgattaacaattcacgctcatcttcagatagttcacggaaaagtttattgaaagataaattagtgagctcacgtcctgtttcagttctaattcctaactcattcaaaaacgcaatgaagttatcctttttccacattacatcttcgcagtccgttttaatcaaaatagaaacaatagtggcaatttcagaaacaatttcaaatttagacattatacatcctacatcttaatggtatgctttgttagtatgaaagtatagtatcatgttacaaggtgaatgtaaaccctgtgcctttagcatactctttaaacttctcaacaacgccgataatggccttcttatctttagcttccagataaacaccacgattatcttcggtgacatccatatgtgtggccaggaagtcaggccgggaagcatcgcgtttatcgatatataatccaataagaccgcttacaaaacgtcccctggctacgctgtcttcacaggacgcttcagaacgaatgcacaggtcaagtttgtattcgcaaacaatagccttagagaggtcaatgaattcacgataagccatagattcagcttcacgttgtgaatgaacaacatcattccaaggagaaaagtcaaacgatttcattagaaatattcctcgagttcatattcttcgataatttcgtttaactgattgccaatatcttcgaggtccgttgactcattgaaggcgacaatttggaaatggccgtcatgaagatattcaatagcaccgtcattgataaaactagcatcactaagaatttcagcaataatttcattaacaatattacgatgaactttcttttcgaattcttcgactttagcattccaccagacggcgtaagggcgagttcctttatgagtaatcatgttctttgcctttatgtttttgtttacgctgggattcactggcggcgcgcttcttatctttatgagcaccacctttgttgaaatcatgctttgctactggattattcataatgcttgattacctctcttaaacatccacctgtaagactaaaacgtttggctataccacattcaataatatgctctgaaagcatacaaacatcagtataaccaagctcaactatgaagtattttattttagccttttcagaacgattcaggctattaaaataatcgcttttagtataaatcaccctcattaataaaggtcctcgctgaaaagttcatctgctggtcctgatttaggacgaactttgttaatttgtcctgcgtgggtagcaataacaagagcttcttcacgagtgaagtattcaccccattggtcaataaaaccttgatcatcgccgtgaacatggtcgttaactactttatcacgaacctggtcaataacttcagccatatctttcgaataatgtcgtgaacctgggattacaagatatccaccagtcttaagtttaaaacggttcgctgcacatacgattcgacgttgaagcagacgaccgtcccaccaatctgcaaccttataacaaatattcaaacgttgttgttcggtttcaattctagacaaaactggcgcctctaaagaagatttgtaagtagtcattatttaaaccaactcttgataatattaacccaacgagattgttgtgctttattaacgccatacgaacgaatcacaggctgagattcttgcaattcacgataatcgtctttagcaatctgtaccgcttgaggaataaagctagagatcgcagccatgaagttcgtacgtttgcctagtgggcaagaggtatcacaacgaacaatttcataaagacctgccttaaccttaacgatagtgccaaggtaagcaccatggaaccatacgtcccaaccttcttgggttggttcaacacaacgacggagttcgttcaggatttcaatcttgttcatcatattttcctcaaattgcgtttacgattacagagatgatatcagcagttacagctgggaaatcgatgtaagtgtttttgccacctactttaaacttaacgtcatagcctaaagaagtaaagattttagcatctttatcggacatgttgtaaccgaagatacgaagtgaaccatcacgacgaatttcgatttgacgaataccgagagtacgttttacgaactgaatttcaaggttgctacggttttcacgaatttctttaaggtcgatacgaccgtcaagaccagctacaaccaggtcagccagttctttcatagtgtcagtcacaccacgagctgaacgagtcttacgtttagtcaacatctcaggagcattttcagatgcaaacagatcggctgcagcctgaacgatgtccattgcttcaccagtagcgattaaaccgtcacctgatttttcaatcagacctttcttaatcagaacaccgatgttgctgttcacggagcttgcattcatggtttcaaccagagcttcacgtacttctgcagaagtgatgtagttctttttaacaacctgtaccaggattgcagcagttttttcgttcagaacgtcgttagaagctttgatgatgtaagttactttagacattttaaatctccattatattttgttcatttcgtttggtatgagaagataataccatgttttaatgctgttgtaaacaccttatgcaaacatttttctgcagaggtcccattggattactgcatagtcaaatttgtaatctaaagccataaacatttcaatgaatgttgctttatctgtaactactggatgcttgtacagagcgattgctttgcgagtaggtttagcaacacgtttcttttcaccaccaaagttcggagaagaaggcttcttagaacgaggcagttcatgattagtgaaagcggctacatcaaagtcagattcttgacgagtatgacctgagttaatcatccactctttacggaatccaggaccaccttgaatgtttgtggtagcacgagcatgtgtatcaccgagctcgatggctttagcacgccatactttgttatggccttcacctggagtcaaagcatgagccaattcatgaagaatcgtttcttcaacctgagcagcagtcattgcgaagaagaagtgcgcctggatagcaattttctttctccatgcagagcaatacccgatgttgcgttttgaagtagatgaaactacatggaacgtccaaccatcaagcccatgttctttacacttggcttcgaagaaacctttagcggattcaactgaatgatacagatgaccttcagagtaaaaagctttagataagatacgttcgataaggttcatattaagttctccatgttggtgtaagagtatagtaacctgttttaaagcagatgtaaacccctaaaacgcaaaaagagacccgaaggtctcttaaaagaagtattcaatgactaagtatataatccataagaagaaaatcattcctacaaatagaccataaaaagtcatcatcttgccaagctcatcagatacacgaccaggcgggtcacagcataagaaatcagtgcagacccacacgccatagcaaccggctggccagccagcaaagtaagaccaccaaacaaggcggcactggtaaatcctacgaatacgctcatttcagctcctctaagtctttaagatattcagttgtgacatcagttgacttccagtattcatgttcttcttttttagccttagcttcaagagcaagctttttagcttcatcagaagtcatgtggaagatattcatagccactaatttttcagcatgttcgccatatacttcagaagcagaaagttcttcgactaaagctttgcgagttttgccttgaacaacaacgacgccatcaattacatctttaatgaatcgtgcctttgccagggcaagtttaaaggcttcttcagtttctttcagtttaccatcaatacgtttctgaacgtaaaccttacgaacttctacaaagtcacgaataagttctgaagcagtttcataaactttcagtttacctttttcgttcacaacagtgatgttctgggaacgtcgttcaatcagaccaaagtctttcatgattttatcatgacgttcttcttcagtttcaccaagattatattctttacggaatttgactttgaacccaaagccattttcatcacaggcgtcatcccatgtaatgaaacctttttcttcaagagcatcaagaatttttacatatttttcacggtcatatttgtaaggaacttcttcaatgaccatttgtgttcttgaagtgaatttgtacttaccatgaagttcccaacgcccgtcaacttcaactacatcacctttgaattcagggaaacttactttcggttcagtaattttcttgccttccacagcttgacgcactgctttcttgaccgaggccatatcatgaggcaaaatatcagtagcataaccggtagcaatgcccgaaacaccattgagaagaaccacaggaataataggcagataaaaagcaggaggaatatgttctttatctttatgtaccggagcatactcagtgtccttatagacattaaagaagtttttgcctacacgagcaaaaatataacgagaagctgcagcttcttgaaccaatcgagaaccaaagttaccctgaccatctaagattggatagttgttgttccatgtgttcgccattaacgcaccagcgtcctgggcagaaccttcaccatggtgatatcctaagtcagccacgccacctgcaatacttgcaagtttatggaacttatcacgattacctttaccaagttccagagcacgagcaactacaaatcgttgaacaggttttaacccatcaatcatatttgggattgcacggttttctactgtatacattgcataagctaaggcttcgttgtcaataatacttttcagaccacgaactgtaaaagtatcatcagcctgtttagccatcatgtcaaaaatatctgtcataatacctaccaaattaatgaagagagttgtactataacatcagaaatgaaaagcacaatagatacgagcccgtatagaactccataataaagaactaatgacaaaacagcggccactaggaccgcaatcagaacctttttcataatttaaaaattacaaaataaagaattaaaagacccatcagcccagatgaaattgctgttgctggaagaacacttgtaaagaacaatatagttaagactgtccagacacaacataagaatgctttcattagccgtatttcgcctcgcgacaaattccaccgatacaagaaaggatccaaccgatgaacataaagcctaagaatgtagtgcttggaatccaagccccagtaaagaaacaaacggcacaaacaattgcgacgattaattcaataaaaacaactagaatcatttaagaaccccacacaaaacggctaaacgctctaaagccaggatagccacgctgtacgcaaccaacccaacaataccaggcgtaagaggagcacctaagaataaaaaggtgcccactacaaacatcatgcctatcagataaagataggccatgcatcttaaggcgctcattagtagctctgcagaatgaatttaaagttatcattcagcatacggttcatttcgctgaagttctgatattcatctttatgcttagaagtgaacatcagagacagttggcctttgccgaaacctgtggtcagaggtttcattttctgaggcggaacaaagtacacatcatacacattgccattggaagacagcgtacggccaagctggctacgaccctgacgaatctgagacagaacgttagcgaaaccagacttagaacgttggcgacctacaaagaagcgtgcagctacctggcgccatggcaatgaacccttaaccatgaaatagaaaccaggttcagccagagtttcgttatcgacataaccgacagttttgccattttggacagcacacacaacagttgcaccaacagcttcgaggtcagcacgggtcatatagttacgaacgtcttgatgtgtcatattaatttcctcagtaagttaaaattatttctccaaggaggacattatactctgtcctcgtgagtttgtaaactatttctttttcatcagacattctgcgtgagcgtagttcaggtcatcaagagtgatgatatcctgtaacagacgattaatttgtttgccacactcataacaggtaaaaattcgtttaatagtcatttagccaccaatgattccaatatggaatgagttgataccgagccaatatggggtgttaaaacctacgtaaaatgctacagcccatacaaaaccacctgccagatatttgatgaaactcataatattttcctcagaagaagtaagcgaagtgaacacgaatcacatcaatcatcagaacaactgggaagattgctaaaaccattgcaatcacaaacatgttccagatagctttcagtaattttttcatatccacctccatttattcagtacagacatcatatcatgctgcgtaatggatgtaaacactcattagtatacaaaccaatggaatactaagaatccatataaagcaccagaacttactcaaagcctgcgctcccgataactaaagaagttttgttgtcgaagattttgcaagaaccattacgatacaatgcagctaactctttggctgcgttttgtgcttgccacgggaacataaattcttcccagtctttgaaacgtggttcgccattttccagttcaaaccagaccataatagttgctttaatcatttatagtactcctcatttgttggtgtaggagtactataacatgctagatttgttgtgtaaactggtggaagttaaaatcttccatgtcgtaagggcgagaagacaggtaccacccgtcattgtattgagatttaataactagaccagaatcttttgcaaaggcatcgcgtccagcaaggaacttaggagtgaacaggacggcgcctgtttcatcttgtttagtgtcgaatatgattattaagtctgcaagcttgtgcccaaggaatggacctaggttgattccccatgactttgccggataatcacctgacattccagtgttcactgtgatatactttgatttagcttgatgggtcttgacttcaatacggacaccatctttagctacaacatcataagcaaaagaccaaggattttcatgattctcgcgaccggaaggcatgaagccatgaacagcattcattactatctgttcagccatcatagcaattaagttgcgacgtaacacatcttgacgattctgagatgggtctttgtctaatgaatagttagccgtattgtgtgccttatctctagctaactgagtcatatatctagaagtcattttagtaggctcgaggcgctgtaagagcgcccaagaatcactgttccgaatcattttcgtccttaggtggatttaaaccctgtgaatgagaaccattaatatacacatcttcaacataaagcgttccttcataacaacggtcattgaagttcaatttactcttatcaagagtactgaagtctacaccaaaataaagatcgttgcaataaaggattccagctccatgtttaatctgaacgtctttacaatagacgttttctgcatgatggctaccatgcaatgttgagtgtttgatgcctggtgtcaggccattcatagggttaatcatatttacctcagaatcgagagattaaaggggccgaagccccataaattagatttgatagccacggatttcagaagtaaatttctcggtaacatcttcgagaacttcatactgacaagtacgcatcttggcatcgccgtaatcaaccggaatacttactacatcacgtggatgaaccttaactgatacgacacgagaagtactgcagctgaagtgcttgatgtagctcttagagcaaacatgcagaccatttgaacaagttacctcatcgttatcgtttacacgagtacgaggcattttaaccgtctggcctgggctgttatcaaatgtacctgagtggtgatctttatagtcagaacgaacaactttccaaccgatgaaatgaccgtcttcagtgatttcaatatcgttcgcaaccaagaagtcaaacagacgacttacagctttctggcttgggttttccagcagattttccaggaatggcagatagaactcgaagtcttcacctttgttcatggaatcaaggatgcggtcaaccaggcctgaacgcagttcgatgtcctgataatacagagtaccatcggcaatacgaacatcacccttaatgaactctttaacagcacgttcgatgttaatggtgtcacgagccttacgtaccagttcctgttcttcagcgtaagatttacctacagactgacttaagaaggcgaaagcggcagcaaaaccagggtggtctttatcagcgttccaagtttcacgaccctgagtaatagagatgaacttggagtttgcgttccagatgaaagaaggttctggagctttggcttgttcaactaccgccttagcgacattaacagcgcctacggtcagagttacatcaccggtaatttggacagtgccatcacctttagcaatgaaacggccacgagaatcacgagcaggacctttcttaggagtaaaggtttgcttcgcagcacggttttcttttaacacgcggtaaatagtatcactagacacgccataatcagaggcaagttcagcataagttttcagtttagcattatgaatacgaacaattttagctttatcaagttcagataggattttaacagtcatttacagtttctctttttaaagggcgattactcgcccatgatttttacaatttcagctacggcattgccttccatattatatcgagtacgcatatagtcggagacaacgatattttcgccttcaaactttttaatacggtctgctgcacgtttgtcggcgtattcatttaacttacgtacgatatgcaacccattataaacttggtctttatgaagcggattcgtgtaagcaataatgtttacttggttcaaccaagaccttaatgcaaacagatctctagcttctttagaagttttaccagattcagtgagatacttcatcaaaaaacttagttcaggatatttctcaatatgtctggtgtaattataagctcgtccgcttgtagcagtatagtagtcataatcaacttcatcaaccaactctacaaatttatcactgattgcagttagcatatcttgacactggtctaacttaataattttcttctgaagctgtggacgaacaatatggaactctgtgatacctaatacatctgcacactggcaaattccaccaaagttgttccatacgccgtactcgggttccattgatacatagttatggccattcttaaacactacccaaccttcgatatcttcggcatcggcagcattatagaacagttcttcttcagcccatgaaccttctttagttttgtaccaacgaactgcgcttggtgcttttggcttaggctgatattcacgttgaacaaccactacgtaatcttctacagcagcaaagaattcagatgtgtacttaatagtcacagggtcttcgcccatttgaatcaatacatcaggtagagtgttcatttccagttctgattctgggttaatgaacagaacttcttcaccacgtgcaggcagccatggattctcttcaagaattttattggccttttcatctttagaccaacgaatctcagccaaagcacgaacagcaggcagacgttgttttttgcaatcgtcaataataatagtcagagatttacgttgggtgccaaacatataattaacaccaataccacctcgtccaccgttagacttcaggcgtttcattttagggtctgaacagatttcgtacactacgccggcatcaatgaaacgactcttaacatcatacttagcataaagctgattatacgttctgccattacaaagtttctgatgggtgttttgaagcatacggtttgcattataacccagaccacctacttcacgaataaccttacgttcgtgggtactttcacgccattctttcaggtcttcttccatcacgcgtttatcaagattaataacacgagatttgatgtttgcgatagtctgctcgtcaagtgacagttcttcacgtgatgcagcgatgtctaattcacctaatgggaacttaatgaacacaacatcattacgagcgccaatccaagtatcgccaaggccaggaacatcattcaatggataaacgatagaaccatatacagcaaacagaccagaacgttcttcataagtgtagtcagtgtctggaattgcataatactcgtcaaattctgggaagaaacgtggctcaagtttagaaccaaccagatttacttttgattcgccaaacggacgaacaacatatttgatttcatctttccaacgctggatatctgcggtcttaacaggaaccgtaatttccagaccagttttgtcatcttctttcatatcttcttcgaacagaagacgaataacaggctcgccattatcaagcattgccgtgtagccatacactttaccttcgtgataagaaacaacggtaaatgtatctgtgtagctaaatggagatttagaaccaaggcctaatgcaccgatgaagtcattagagttgttcttagttgatgcaaagtaagtcgtgtacaggttttccagaccgtctttagacagacctgggccgaagtcacgaataataaaacgtgggtccatttgaccgggtacgttaatctggaatgcgccttcaaaaccattcagtttatgagcatcaaggcagttacatgccagttcacgaacaattgcacgaatcttgtttttatacagaccagaagaaaggattttaaatgcctttgcacttgtggtgattttaaacttggtgtttgcacccttactgcccagtactacttcatcatcgccttggataatcatattaatttagtctcattcacaatgttttttgataagttctgccacttgaagaagttcatctttagtagcggtgtctttaagtattttattacgaatttctttgaagcataacttaaactcaatagccaagtcgatatcaaagaaacgttctagaattctatattcacggaaaactgcgtcatcaaataattccagattgacattataacttcgcattcggtaatacctcatgttgcttatactcaagagtagaaccaatttcacgaagtatcttacgcatgttacccatggaagctttgtgagtttggtcatgataaatcaagttcagaacactctcctgttgttcaggagtgagcgcctggttgtttttaatttgaacggcaatagatttaacagtctgagcatacgcgcgtttcctgtcgacatcgtgcgtgctattcttggccttacgtattcccgcctccatcaccactaaagcaaggttatctaaattaactatgctattgtctgacataaccataaaccgttcctatacaaaaatgggatgtagctattacaccacatcccttagaaagcattaatggcttaatggaccccatccgccttcaattttataagcttgcccacgaactttagttaatgaaccatccgggttttctactgaaatagtaacatattgagcaaagagaggtttctcttcagcccaaagataaccaaattcaccagtagctaaagtaatccaatattgtttcatatgagctccttattacgaggcaaaaatacctcgtaatatttattaactcatccaggccttacgtggcgcagggtctttacctaacaacatctcgaattgttctttccaatcatccggaagttgaacaacatcatacttaggattcataatcatctgcttatattcagatttctgaagcgaaccaagtcctttgatatatcgaatagaatgtttaggcaatttgtctttagccgcttcatattcaggcagatcatagaaccatttctgttctttgccaatctgggcaatgataacaggagttttaacgaatcttactcgaccttctttataaagctgaggccattgggtaaagaatgcaagcagtgatggataaatcgaaccggttccatcgacgtcagcatcggtcatgatagcaatattacgataacccattgaactgatatcttcatcaccaatcgtcaggcctgtgatagcacagatatcaaaagcttctttgtttttcatgatatcaacaccagacataccccatgtgttcatgaacttaccacgtaatggataaccaccatgcagttcacggtcacgaacttcaatcagataacctattgctgaatcgccttccgtcaagaacaatgttgtgtcagcatctttaccgtaaaggtttgctttaatatgcttttgaacttttgctttagcagcttttttattggctttagtttcagcagccttttcagcagctaatttacgagccaatgcggcttcaacgataggcataataaggccttcgtctttcaaaatagcattagcaattttcttggcatcgatttgaatgtggttacgaatttcaccgaaaggtgatgtcaaacgttctttagtctgcgaatcgaaacgcatattgctcatatcacgaatgaacatcaacattgtcagacattctttgacacgtgctttacttacttcgatacctttatatttcttcttaatgccaggcagaagatgttcacagatatcatcaaacacacattcaacatggtgtccaccattcttggtatgaatgttgttcacataagtcagatgacggaaaccatccgggcttgttgcgaatgccatagaaacattatctgtttcttgaataacaacgttttcaccgaattgtttagcgaactttttaaagttgccatctactttcttaccattgaaagtaaattgaataccaggatatataacggccagagtttgaaggcggtccagagtaatcgcatgatacatgtcattcagttcattagtttcgaaatgttcgaaatcaggaataaatgaaacgattgtgcctgttttagccttcacatgttctttcttagaggcaggaaccgatgcccacgacttgttttccatgccattagaacaacgtacgacaatctcattctcgccatcacaggtagcgccagcgaacataacagagaagatgttggttaaactactaccgacaccgttcatgccgcctgtcttacgctcagcgtcatcaccgaagttaccaccagcttttgggatagtccatgctgctactggtcctgggatttgttgacctgtctggtctgtaaccatcgcttgtggaataccacgtccgttatcttcgacaataactttattgcctttgatttgaacgtcaattttattcgcaaacttaaagtttgtacgaatagcttcatcgacgctgttatcaatgatttcatcgataagtttcactaaacccggaacataaggaacaaatacatatgaaccgaacagaaaacgttcatgctgctcatttgcactagaaccgatgtacatcccactacgctttttaatatgttcaacgtcagacaatactttaatttcgttcttaatcatttcatttcctcatgtagtaggagaataatatcccatctcattaaaagcagaaaaggagcactaggctccttacatttttgcatcgtgaatcatgccattgtgcagcagacattccagaagccagataagcacggaactctttctttgcttcacgcttttgtttatctgtcattggaacaggccggtaatatgaagatgctttaccacttactttcatagtgaaaataaatgctgcactaccgttatacgggtgtttaccatatgattcatcgattttcattattcaaacctgatagtagagttcttaaagaacataccagagcaaacagcacctttaacaggaaggcctgtaggacctttagcgatgaaacctgtagagaaagtatcatcagaacaactcaaccaagaataaccagtaaactgaatttcagtaaagccgtttgctttaagaatacgttctgcaccagcctcatcggtgcaaaaagaaagaatgctgattgatagaattgcggcaattaaacccattacgaatactttcattttttagccaccttgataattttaccgctgtgtaatttaataacccggctttcgccggatttcataaaacgaatacgtggtttagtgcccattagtaatcaccacttttgagtccgtcataatgaactgctggagcagaaacaacacgcttcatttcaccttcacagttcaggaacttgcaaggctgtggattatcacgttcagaaatcttaacattcttttctgtctgttcaccacacgcttcacatttgtaatcatacagaggcatcttttagtccttgtaacataataattgcagcgtgtacttcttccattgtagtaatggtcagacgaatttcaggaatagccaagagattatggaatacagtttcatcttcaggcttaggattgatccactcaacgaagaaactcattgcttcgtttttagtaatatgacaggaataattaaccgaataagtttcgctcaattcggcagaagtcattactttaccactaagagtggtgaatacgttataaattccttcactctgggaataaccaagtttaattggaccaagatcatcaaaaactttaataagtttggtgtttgcaccacaggcagtcataaagccttcacgatcaccaataacaaaatatttatctgatggaagaatattaatcatttgaacaccatattatttagaaattcaattgctttcagtcgagtaatttcatcttcgactacgaaacgaatcttacctttgacttcaatcttaggagattctggggtcagttcggctacatcacgtgcgatttctgccatgatttcggcatcagtttggccacgatctttttcttgctcttcgatctgttcatcgacccagcctgtagtaggcatttgaatttcatcgcacttaccgagattaaacttattatcacgttttggcaaatcacgaacaatagattcaccacgaatgaaccctgagcaaataggacgtttccactcttcaaaatgttccagttcgtctggagtcagagtgaagttcaggtatttatggtttgctctgttatcagggtccacgtatttaagacgcatagtcttaaggtcataaacaccactcatacaaacactttctacgatgaatgggttataaccaatctcacgaataaattgaagattgattgaagaacctttcagaagagctgcggcatctttcaactgataagcggcattaacacaccaggccatatcatagttgatttcaaagtgagtcagctcgtttactgcatccagatggatttgagttctttcttcagcatggttttcaactacttgagcgttaccataatcatctgtttcgagaactttgaaaggacgaccacctacaaagttggcgaacgcacggttatcaccgcaacgtctggtaaacagagcatggtcatgcatgctcttgaaatgatagaagtaaccttcagtgaacttatgcattgtaaacttccttccagtaataagcgccatcttcagtgatttcttggaatacaccgtacagaggtatttttgattccactgtttcatacacatagaaaaccgtagtatggctcaagtggtcattccaacttttttcaacaacaaccaggtcattggcatagcgaacatcgtcaaactggccaccggtgatgtttaaagtagttttagctttcattttgttttcctctcgtttgttggtgtaggaacataataacatgaacctacaccgttgtaaacacttagatgtaagaatctatagtgtaagctttagggcctgcgtcaggcacacgtttcatagtacagattaccatgctgcgtggtactacagagaaagttccttcgtgaacgatgttcagaagttcaacgccttcttcaagccactggtcagatacaaagccaccaatacgagcaccggtatagaaatcttcgaacactacggcacgagtcagcagatcagttgggtctttgataacaagaggcttaatttgggtcagatacatatgagcgacgtcttcatcaacaacataaccaccttttttagacgaatatgtgcttgtaggagcatcagagccaatgacttcagtcacatgttcaggtttaacataaccgacaacaccaaagtccgtacggactttataaccatcacgagcagaagtaccaactaccgtaccagtttcgccagcaattttagagccagacaggaaagatacgtatacgcgagaaccaattttcataatcacaccttaaaataaaataaaatcaacttgaacagcgtcagcacgtttgaacataacttggctgtcaccgagtagaacactattatcatctacttcgtatatagcaagatagtaacctttgttacgaagcgaatcaaaatcacaatcatcaaaccacttgtagaaatgaccttcggtttcgaaaccaaaatagaactctttgtgccaacgtttaggcaactcttctttagtttcaacattaaaatgcgttagcattgaagcacatagctttttgtcagcacctggaggtggccggttgaaagcacctttagagtcttggaggtgacggaaactgccttgctcaatgccgtgaatatccatccataggatagtggcttcagagttatcacaacctacccacccataaggcgagcgtggttctttgttccatgatggcttatgttcaaacttgtctttgattgtggtccaaccacctggcggacagcgttcaaatttaagttgacggacatcttcacgacgagtaacaaattttctttcaacacgatagataagcatgatgacctccattaataagtgaggtcatcatatcatgctctaaagtggttgtaaactacccacgtgaaacaggcagagaacgtgggtcgacattatcaccttcagggcattcgtcaagccccatagcgtaacgctgagcaaacttaagcatcagaatgtctttagcgcagtcatgaactgagtcgtgtgctacaaagccatctagtgtaccttgaaccataggagtagtagataacccacgaaccatagcatatgcttcaatcgcagttcggatatcacgctggttccagaacttcactggttcttgatggaacgtatcaatatcttcttcagcaacaccgtcaacacgataaaggtcacgaatcaggtcaaccagaatcgggaagtcgaatgacataccacgacaccaagcctgggatttccatgggtcgacatcgttttcacgacaataatccaggaactgcttaatgccttcaagagttaacacatcatcttcagtaggagccaagttagcacgagcttctgcagattgttctttccaccattttacagtgctcttaccgaatagacgttggcctttttgttcagccagtttaaatttgatacgtttgccatgattaactaaagtgtcaaaactttctactttagaagggtctgggtcaaaagcaataacagccaagtcgatgacagctgctttgcttacgttgccaaacgtttcaaagtcaataattatatctttcatagtttacccatttgagcaatacaagtcaattctttaacaatattatcgcttaaaataatatcaggttcacagcctaatgcagaagccaattcaatagcattatcacatacagtacttgcctgataaagcacttctaaaatagattgtgattgagaaccacgattgaatttttctttatcattcatggtattataagcacagataattttctgtgcggcgtattcattaattcgtaacattctaacctctaaacataataagcatcatgacgagctcgtgtaagccctacgtaagccagctgtttagcaagatttgcttcagccatgtgaatacaaggagtatagatgaagctattgttcacactgataccctggcttttatgtattgtactcacaggaagtgcacgcactttaaggaacgtacgtttaattttccagaagtcgtcccaaggtggacgcttaccggcagctttcatttcacggtatgtcgtagctactttagccaagaacatatccattttttgatattggtctaacggaagaactttaatcacttcgattttatattcttcgtccgggtcgattgtctcgacttcaagtgcccaatagttaatatgttgtttggtcgaaacgttgcgagcaattaatggcatgcttgttagcattgcatctttaatgcgaaccatttcaccgttgttgaaaacaatttcactgaactttttaccatcgaactcgagctctttaataaatggctcttgcataacgataacttcattattgatgaatggagtttcagtttcatacagcttacgacgaataatattgttcagcttttcaaccgacttattcgtgaatgccaacatacgggtttcaaacaggtcttctggagatttcacaacttcaaagtactgcatcataaaatctttcagagcggtattacttgcgaactcatgaacaccatgtccatcaatagtatgatgacgtaaccacccaccagtacgaatttcagtagcaacatcgatgataggagcattagaacgcattacctgagtcagatgaacctgcttaaagcttggatgtgtaaagaacggagaaatctgaggagttccatcacttcctggttctacaggttgaagctgttcacggtcaccaattccgattaatacacaccaaggtggaatagaatttagaatgattttgaaaatcttaccatccaacattgacgcttcatcacagactaatacgttacatttagacatatcaggcatttcgcgttgttcaaacacgtcctggtcttcgtatgtcatagggttaatttttaagacgcggtgaatggtatttgcttccataccagacatcttggctaatacttttttagcctgatgtgtcggcgccgccagaacaactcctaacacaccattacgtatgatatgttgaatgatgaacttagtcagggtagttttacctgtgcctgcaggaccgtttaaggtcagtcgttcgccatttcgtcgttgaattgccgcagtgatgatatcaaaagcttctttttgcccttggttcaaatcttcaaacttaatactcataccaacttgacctttttaataaacagcgtattgaacactcgagctttaaacataaactcttcatgattaagcactttgcctgggaaattcatttcctttttccagaaccaaaagccagtcacaacctttacaggtttagggttcaattctttattaagggcttcatgctcggcatcaaaccatttttgtgcaatttccttataaggagtgattataactagctcttgactagagttacgatggaacaaaggcagctcaaagccgtctttatctttgtaatataaagcatatccataatacattttttattcacctttttgaatcattggaaggccacgctttaaacgaacatagttatgagcattcatgtattcaaaacgaagcaaagctgtagctataataccataggcctgggaagcgttttttgcagttttaacttttgccttagggtcttctttagccttgttcatttctttttcgaacagaacaagaagacgagcagcttcttcagttcctgaagcgatacgtttcttgagggtttcaattcgaaccattgtggcttcgtcaatgacactagcagcttcaagatttttgagggattctttacgtccttctacattctttagaacacgaagacgagtaaggtggaattctttggcctttttaggaactacaaacgattcaggctggtcaagatttttcagacgttcgtcagccacaccagaagccgccatgagttgctttaaagacaaatcgccacgccacaggttgtatttcaacttaacaggaactacgttgcctttaacatagcctttatcattatcccagcgctcaagagtaagtttatcgtcaccactgccaaacttttcgcctgaataagcacaatgggtctgaagaagaatattctccatatatgctcggtcaaggttaaagtccttaccacgtgagcgagcagattcacgagtgtgagacagacgacgtttagcttttttctggaatggcgttaatggttctgtagacattttgtttctccatgttggtgtagaagcatactaacacgttcctacaccgttgtaaacactttcttgctttttatttccgtagtgtataatggttctgaggttctaccattcaatcagttccaggtcgatgatagtataaacagtttcaacaccataatctttcactgcttggctaccacaaatacggaacgttgcttccgaaggaagcataaactcacactcaccttgaaccatatctaacttatcttcacgttgttctttcacttccatctgacccatgaactcttcatcaggtgcagccagcaaaatctgaatcatttcttcttgataattgaaagcatatggacagtttttgatacggaaaacaatttgagaatcatagtgccactttgaagcaaattgtttagctgtactgaagtcagaactaaagcttgttacgcgattcagggtgaacgtttcaccttcagccagatcataaattttatttgcttcaagcaatgagatcccacggaataacggaggaaccgtagatgatagatgcttacgtacaataggattcaatagctcgtgaatatagtcggtattcttatcgttcatgcacagccacagaatactttgctcctgatcagtgaatttttcatctacacgttgttgaatgtaaagacgttctttttcttcttcatctaaaactagttgtttgatcgtagaaacttgaagcatgatgacctcctttgtaagtgaaggtcatcataacatgagaggaagggcttgtaaactacctaaatatgcccatcgggataccgaagactgcgatgtctgcagcctggcctagaggagattgcgagtggttgtaagagcttttgaaggattcaggctttttaaccttttcttcaatcacttcagtttttgctttagatttagcttcaattcgcttttgctcggcaagtcttttcctatctacatctaatgtagaggtaggtatgttcgttaaccaattcatcatttcacccaaggtgcccacggtggtgggtcatcatagtaagacgcaaggtcttgcaggacggcgagagggacactgataccatgtttctgaataatcatatcaagttcatcaacaagttcttcacgcgccgtcctaggcgcttctggttttaaggatgattctgtgtctgggataaccagcatatcaaacaaatccattacatccaccactcacggataagtggacgaccaggcccatatggctgacccatttcaattgtcttacgcatattatcagattgcttccaatccacatatgataatgaagactctgcccaaaatttataagaaaagtatgataagtcgtcctcgcattgtatgataaacttttgtctcatagctttttcttcagaatcataagcaaaccatccaatagcatcacctgggtaaatatatccatttttagttaaagacgtcataataccccaagggcatccggatggtaaagtcccagtgtaattatgggctagttcaaccatgatatctttaggtaaaggaatctttttgaattcttggacaaggtcttctattttacaagtataacggtcgccttcgacaaaagctatttcgttaacaatttcatcttcagcccattcattaccacgttcatcaggctttttaagcttacgagtaatgcgtaccgcataattatgaaccactgctgacataatattttcctcaatttaaattaatcgcaagaaccgccactagacccagaatcacatgaagaatatcctgggtcatatccacctgaagtagatggtgtataactaggcgtagaatgcaacactgtatcaggagcaaccatactcatatgggtattatctgtataacttcggtcgtaatgggttgcagttggtgcagttccagtacgattagggttttgattacgagctttacttaaagccatagcacttgaaccagcagttgctttagggaaagggtcaccacgtctgacaacttcttcaatcattccgtcacccatatagatgtattccttttcatattcttcagcaaaacccattttctttggttctggctttgtttcaaaaaggtttttgataaatttaatcatatcgttatattctcgaatttaatttgaacatcattagacgaagcattgtaatcccaaaaacgaacttcgagtgatgcttcaagacttgtaccaacttcacggtaaccatgaacaatcacatcaatatagtattccgaatcaaagtggtacttatcaagataatatttggcaataagataattaattccaccacaatcggctactggcttacgccatgttgttgatttcatgatttaatcctaaaaaggtcatcagctaatgctttagcagcctggaaatctaaatcattctgcttttctttaactaaattctgtaaatggtcttcggtttgttcattgaagtcattcatagctttccagaactcgtctggttgtgaaagccaatttttaatccaaggtaaagggttcagtttcatattttcctcacttagtagatgattcattctaccacatggtttaaaagcaaaaaaggactcccgaaggagtcctataatcaaacgcctgcgctatcagccgggacaccgacaaacatcgcggcattcttagttgcccaatcttctgcagtttcaactacatctgcataagcaggttcttcagatgggaaaatctgataatgcgcaccggaaatacgatgtgcatcagaatatactttaaaagcaacagaaacttctacaccttttacttcgctagatggcagagtgtggtcgaaagttttgatatttacataaccgcccataatgaactccttttagttggattgattacgagcgtatttatacatctctaaaagagtatattaaatttttgagagcacttgcagtaacttcatatttgcctttaagtgctttaaccacaggccctgtggtaggtttacctaatgaaatccaaatttcatagatttcgcttttcaatggttcatgccaatgaggcgcagttctttgcgctttagatgtggcctctgaaacctttttagcgccgccattattgtaaaagtttgtcattattttagattgcctggattttctctcaggcctgttctgggccgtagattgagctttcttcattcgctcttttgtttctcgagtgtttagacgaattttgtgagctacgcactgttcttcagaccatttatagccttctccaccttgcccacccggaaggatgtttaaacaatcttcgttgtgtctatctctcaattcttttattagagttctttcagcctcataagctttttctcgagaaccatgacatttagaccattttattctatactttaatccatacttacgataaatgttccaaagtattttacctgaacctgggtatttgtccttataagggtctagataatacgactcatgcttaccaccataccaaaagacgcctttcggcgtcttaactcgaacaatatacgttcggaaaaatttagtcttaatagccattatcttgacgtgcaaaattctcgacattcttaagatggtatagcttataaatttcctcagcgtccatattcaaacctgtaaacatattcaaaacaaaatgaagaatatcaatcatttcgaatttaatttctagctggtcttccggggacatttcagaaatatgtttagattgagcttctatataacgccctttccattttttccatacggccgaagcatctttatcaccacgtgacatttcacccaatgaagtcagaagttcacggaattcatcatcgatacaatctttttgttcgcgcatccaggcaacaacatcgcctgctgtagccagtttatcagggtgatagcaataatcacggtcattagccagacgtacctgcagagatttctgcatatcaagcattgcctgcagtgggtcttcattgccacgcagcataccgtaataacgaccagttgcgtggtccagtgcagctttatcttttaccagttgagaacattcgttaaagtgtgccattttatttcctttcaattcaagtagagattaattataacattatgtttattcagcaactaaacctaaaataacagatgcattacggaagtgttctatcttttcatattttgcccagacggcatctttatcttcaacgaagtcaaaatctgttttaacacgaagatttaaaagacaacccatgatatcatttaactcatcagttagacgctgacgattagttttgccttcatattctgagtctaatccgaactgcataatcttagagcaaagcatcgcaacttcattgcattcttcacctaattttaaaaaagcatgttgttcttgattcatattacaccataaataagtttggaggttcttatgactaaaaagccattatttaatttaacaaaacataagaagaaagtacttgctgtagggattattgctgtgatgtttatctggaactttatcatcgttcctatagcggcattctatggattaacacttccgttaataaccatagaacacctcagaacagcagctacaatacttttaggcttctaagcacgagaataacgtgacagcctcatctttgccattaacccctgttcagtattcttgttcatatagtcaagaatttgttcaggggttgccccatcatctttaatcatatcatttatatccttcgaaggccatggagccttgtcccagaataaaatcctttcacctgcattaacaagtttagtcatacgtttaatagtatctggatgtctagcttcgttatccatcacccaaacacgggtctctttaaatggaactgtatttaagtccatagaaccgcctgttatagctatagaattcggtatgaataaactatcaataggtccttccatcacccagacacgtttacgttcatcaactgtgtcgagtccatagatttttgttgcgtcgtcatatgctttgattgtgatatatttctggggagcatctttgcgtagagctcgtccttggaatgattcgatgtctttgttgctgttgaagataggtataaccaaccgcggttcattcgtttcattactgtacgtcccaggtttcacagagttaacaagagcaggccactgcatagtaaaccataaccgatgccattggttctcaggaatgaacctggaacgaacatatttgattataggatggtctggttgtaatttgtcaagacgagtacaatactctaatttttcgataacaggcatttttgctttaaacttatccgaaacttcaacttcctttctttccggcttagcaaaagtcttttctttccttatctcaagaatatattcccgataaaggtcctcttcaaattctttcaagtacttgctcaaccatgcatcatattcacagttaaagcaatgaacacgtattcctgaatctttagcaggataagcccagaaacgagctttattcatgtctttttgagagtcaccacaaactttacaacgacagtttaatttgaagtcgctcccggttacttgtctgaatttaggctgatgagataaagcccttaatgcaaattcacgatctacaaaactcataatggtccttaaactaaaaaggctctcgatatgagagccattatattatacttcttcggacttcttagatttttgcttcttagaatggatttgttcagggcctttattaactacagcgcctgaagtggttcccgaggcaatattctgcggattaccaccggcatcgcctgcaaccatatcttcgtttagtttgacaaactctttatatgttttcatagtcacctcggcctatttatagacctataatatcacagtgaatgccttcccatgaatcttcccattcacgagcttcaattgcttcaataatagaacggcgatgttgtttcttaagagcacgaatctgccgcttggtaggacgagttgcataatattgcattgtcacataaccgaatggaagagacgcagtcccacctgtgtcaagaaatacttcctattgggcaatggtttcgatttcagctttagttcctttatgcactacttctggtgaataatacattacgatttgtttcatttcttcatccagtaattaaagatttgtgaatcaatatcattctgaactgctgtttcagaataaagaatatcgtctagtttgaatccagcgcaaatataatctacttgcatccacccttctttaagttcatcgatgagatcttcatcaataccagaagtagcagcgagttcgatacaaatagttttcaaattttctaaagtaagcttacgcccgtcagacggtaaatgattgcgcccatcaatattagaatggtcgatatacgtacatacggtatttgttacagtattaagaagaacagttccaatccaaatggtgttctcatcataaactttaagtttacgttctacacggtcatacattaaattgaataagtacattagtctgggtccacgaattctacagcttcttgaggagttttgtcttcacagacaaccatttgggtagcaactaaaatatctttgaaactgtatgactccaaagtcattgcacgattcttatcaattttgccacggaaaatacctttagcaaaagcacgaagttctggctcgtcaacttcagcagaatagatgcagtctggagagttataaccagattccatctcagattgctcttggcgttcttgctgttgggctgtcgccatcatattagcaacggccatagagtttgcaaacgatggctgggcaccacacgcacttaaagcaaacgctaaagccagagttaagcgtttcattcttcttctccaaattcttgttcgtaatcacaatctaagcaagttgcgttatcaaacatatcaaaaacggctttatcttcagtacatgaacaaccgcatactacacactcaaattcttccatttagatttcctcgcagaaggcccattcagcgtggtaaactgtagcgcctttagtatcacttaaacaaaccacatctaccggagaaactacacgatagataactggttctcctccgtatgaacgtgcagcacgtccagcataaatctttgctagtccgatatcttcggtgaagaatacacggtctaagtttttcttacgtcctacttcagaaattactccagtatcgacaggtggacaaagcatgtttttgatgtttgcattagttgtcgagccatgatagtaagttttcattttgttctccatgttggtacaaggctataatatcacgccctgaggagatgtaaaccccgaaaggaggccgaagcctcctcttagaattttaactgacccgcaagttcatcaaggtcacttcgattgacacgagcctgcctgttagcttcggcctgacgattcatctcgcctgtggcttcacgtacagtagagataggtcctttaggtccaccttcatcttctacttcaacccaacgctgattgcccttcttaacaccaatcttgaacttattatagtagttcttgtcgccataacgtgacttcaactgtttaatcatttgaagacccatctgtgcaaattcttcagtctcaacaataccaagcatgaagtctgctgtgtgtgcgataccaaatgattctgcaatgtcagccatatcaatttcagccgaaacgttagcacctcttgttgtctgtgctgcagtccacatgacgattttcttttctaccgccagaccacgaagttcttcagctaccatcttaatcagaccataactgttttcggagaacactttaacacggcttgaagcacaaatagctaggtagtcgacaatcactacatcaggaacaaagccttgcttaagcttatattcgttcaacagtgcacggaatgtatcagcattagcaccaccagtaggatattgcttaactttaagcttacctaaagttttattctgacgccatttatccatcttagctttatattcaggccaagatacatgtccttcgtcaaggtcatcaagtgtaacatctagaaggttagcatcaatacgcttagcacatacttcttctgccatctccatggagatatagaggacgtttagaccagactgaagataatcagcagctaatgaacaaagtccaagagacttacctacgttcgtccctgccaacagaatattcaatgtaccgaactcaacaccacctttagtgattttgttgaaaatattcaggcggaatggaaccttatttgctttattcatgtatgtttggaaacgagcttcgctatcttccatccagtcatgaccaagctgtgagtcgaaacaaatagacagtgcatcgcgcatgatatctgggattgcaccaatacctggcaacttacggttctgttcatgtggtggtaagtctgcgttagtctggatttcgataatcttagacgtcgcgttatacattgccgctttctgaacatacttttcagtttcagatactaaccaatcaaaatcttcaggacctgcatttaaatcagaaagaagagctttagtttctttatattcgatttcaccgatattagcattgctcaatgcaatatctaatgcgtttttagaaggaactgaattatattcgtttacatgagcctttaacaatttgaatagggtctttgcaggaccctggtcaaaatagtcggcattcatataaggccagacacggacaaaatagtccttattgcctagcaactgtgctaaaattgtttctaccacttccaccaccttttcttcatattaatttctttaagagcttcattaatttgcattgtaacacatttttcaacgtgttcggctaattcgcctttacgctcttcggaaggagtaccaaaatctacggtcacttgaccttttggagaaatatcaatctttgtaacataaaccatatggctactgccatcaggaagtgttaacaaaatctcctgcataacagaacccatgctctgtttaataatgtctaaagacttctcataatactgagggccactagggccctcttcagtgtctttgacaaagttgtccagatcggacaggtctaagtcattactcattatcttcttccatttcgtcaagagcattctcaacatcggctgcagatggtttacctttcttacctaagtcaggaattttactcgtggctttagtattaagtaaatcggcaactgcatcatcaacttctttaatagaagagattgcacccagtttgtatttggtttcaattgcatcacggaatggcttatgcttgaacagaggaccccagaattcgacatcatctgtagctttagcacgccatgatttttcttcttgaaccatttcgccggtttcttcgtcaaggaatgcacgagaataccagccagcttttggtttaacaacaaagccaagttctgtagctagttcaagcagaccactgaacgggtcaataccacctttaaagttcaccgtaattgggaatgtggatttttcttgaaccgtacgagacttttcagctttcagtgtgaagtcatagcctgtgagttcagtaccatctttaatctgacgtttagagatatagaataccgtcgaagcagaataaagaataccggtaccaccacccatgatttctttcgggtacataccaccgatttccattgccgtatggttaatagctacgcacggaatatctttaatggtcagataaggcgttacgatacggaatagagatttcagtgacttagcacgagacatatcaccaacttctttttcgtccagagcatcttgtgtttctttcttagatgcagtgttaccgattgagtcgatgaagataataaccttttcgccacgctggatttcttccagttggttggtcatatcaattttcagcttctctactgactggattggagtatgtacaacacgttctaagtctacgcccattgaacggaagtaggattcagacgcaccaaactcagagtcatagaacagacaaattgcatctgggtatttcttcatatatgcggcgaccattgtcagaccaaacagagttttaaagtgtttagatggcgcagcgaaaatagtcagaccagattgtaagccagtgttcagaccgccacctaacgcaatgttcaacattgggatacgagttgggacttcatcacgaccgttaaacagttttgatttagtcagatcagcagtcagtttagttgtagaagctttaatcaggcgagattttaaatcggacattatatttttccattggtcaccattatatttttctcacggttagattagaaggtaattatatcacttcggatttacagcacgttctgcacatgccttagcccatttcttattgttctgacgttcccaaaacaataaaacaaatagaccgcctaggctaagaagtcctaggctaataataaagattaacgggcccatttgataatcatcgtaatcaaagtattacgctcgtttgcattaaaacttttaatcttgttgttgccataatggttcagcaattgatagatatgaacatcatttttatctgcaaactcttcgaacaatgagatgaccttattgaaaccttctgcagacaaagaaatcaaatcatcttcaaagtcttcggtcatttcattacgagtcagaatgattggcagaacattattatttacacaaagacgatggaagtcttcttcatacatatcaagaatagattctttctctcggcgaatcatgccataaacccagtttgaaatataaccacggtctaacagataaatcttagatgggtctaagtatttcaacattgtttcgaaacaagccacttcatttcgtgacttgatatcgaaccgtccttcagaagtacgttttgggaattcaatcttcacataacggtctgagatttcacagatatcacgaataagagatgttttaccggcgttatccgcaccatcgactaaaataattttggttttcattcgttaattaccacgtcactatacataggaatattatatggcgaagaaatgaaagcgccaaagtaaatgaattcagccaaaccaggatggaatactttttcagggttttcgaaatactggatatgtggtctgcctttcagtacttgataatattctgctttagacagtttagtcaaacgaatcacggcttcttctggataatggctacggtcgaaactatcattcggatcggtgatataaaccggttgctgagtttgaattgcacattcaacaacttggttaaaacgataacactgatcactgatacggaacggatggaagatgccattcacatgtatcgcttcaagacccgcagcgtagcgctcgataacgctagggcgcacgaccttttggtctacaataatcttatactcatcagcaccgtgtttaaccaggacgtccttctgacactgattcaatactgtcgtatacttactacgatttactgatgcaacatcttcttcaatgaattggtcgatatagaaaagaggcttttctggattcattgtgatgttaaagttgaaccataccggatgacgacccttataacctgtgatatctgttacaaggccaacaacatcataatattctactaacgaatcaacaacccattggttttcttcccagaaatgtttacgagtttcgaaagcattttctttataccacagcgggacaaattcgaactcagggaataattcacgaagttcatctgcatcagaagcatttttaggaatagcgataatatcgccagcacgagcacggttcaaatgaagctgaagattgccgtccttcagaacggcatattcaccagtttcatggctacgcatactataaattggtactcttaaatgtggcatacttttctcactcatttagccaaatccatctataaccataagctgttttagaattgttggctgctttaataatattagatgctccgggtaatcctaaagctcgtctagcatcttgtgcactttcgaatttaattgtatcacaagttaaaagatttataccttttattgctttaataagtttttgagaattgcttatcttagattttgcttcatctgaaagggatttacctctcatatagctaggtttaccataattatggtgtttatcgcctaattgcctagaactcattttcctccgggtttcttcggatataactcgtgtcttactataagaacttattttagctttagcttcttcagtatgtttatatccagaagtcccgcctttaccacctaaacgtagattataacattttgggttatcaactgcatcttggtctactaaaagttcttcaaactcataggctaaatcagaggtttcaaagaaagcacaaatttgcatttcaaaatttgttcttccgtattttctatacgctgacttaagaataggccctgaacctggatatgaatccattaattctaatgatgagtgcttaccaccataccaatgtccgttgataagattttttataatataaacaaaattatattgtttatcggagcccatgaagggctccgtctttttatcgatgaatttcttcatcttagtctaagaatcctttaacataatcgaagtcacgttcaaatatatgagcagagaccatagtgtgagtgtatgtacctattttaacaccgcattgttcagcaataaaggccatcagcttgccttgcagatagaagtctaactgcataactatagcacagttttgtgaacgcatatgacaatgagcatgaagcttaccatcacgaatataatacgttaccgaatctgtacaagggtattcaagggactcgtcgctatccaagagcgcttggtcttgctcttggagaatctggaacacaactcgacgggaattaggcttctctttgagttctttaagaagagctgggagctgcgcaacgattcgtggtccgtagaaagtattaaagttcgccggtaagacatcgctttttggtttggcaatgaacttagcaacatttggatattccttaaatgcttcttctgcgtccgtaccacctgaaatcatgaattgccaaaatgcttcagcataatcataatcaatacgagagatacgtttgtcagacattttaaacgttgatgggtcttgaactactacggtcatagaaccgatttcattacaacgacctatacgtgaatcggtaatgaattcaggattgtctagaatttcacggttaactgctttgaatacatcttggaactgtggaaaattaaaatatttcattcgattgtgctctgacataatttacttaccttaaaaatttctctgtatatgcatcttaactcaggagtcatatcagctaatttctttgcttcaatttctaagttttcgataggcagcccgtgtttctttttaatacgtcctatcccatcggtaatagcaagacgctctaataaaagaacttcaatttcattatcgatggcttggacctcctctcggaggtcatcaagttctatcattcagggtacctcgttgcatcatcactattatcagtgatagaaacgatttgaatagagttcaatggcatatcattcttagacaactggcgtttgtaataacgttcacagtatgtacatgtagagccacatacttcattagcacaatcaaacgtagggtgtttaaaccagcgtttctctaagaaaccatcaagtaatgaagtctcgatattaacagtatggctatagtttgcatcagactcattattgtaaatggtttctaatggcttccagagctcaaggagattaccttcaaatttctcagaggaatatgcctctaatactttcatgatgtactctgttgaccctgtacgtcctgacactttaaattgggtgataccaatatcacggtaaagttttaggtcctgaggacgcacaaaacgcgtgcgtaaccagttgaaagggtcggtgtctcgagctttaatgcagtgctgcattggataaccgtcgagcgattttgcatcttctgcagtaacgtcggtactgtggaaaatatagcaagaatcgcgataactacaatgagttgtatagcctttgcccgcgttagagcaaaattcgttaacaaggacttcaaagataataccattttcattacagaatgccgcggcctgcttcaagaaattaaccgagcggtttttatgaataccacaacaaactttcttaatattgtattggtcatgaaggtatttgatttgagtaacagcatcaacgtgcaggatagttgatacctcaatttcaatttctttattcacttcacgaacaatttccattactaccgggttagcaatagtaattcgccagacaccaattgaccatagatattgaacatattcttgaatggctgctttcttccattcggtgagttcacgcttagttcctgggttaatgctgttcaacgtatagttaaagcaaatgccaagttcgttacaacgacgaacataaacttccagctcttcatcttttacatcaggcagacggaaatcaggacgagcggcgacaaatgccatcgctcgtgtacttccgtaaacttcgttaatcagtgattgcggatttttagcattcaactcaacgattttatcaagaagtgccaagtcaaaattcgttccgattttaaatgtattttgcattttcatctcttttaagcaggaaaaggatgcgatgtcttttgcaggctattaaattaaaggtttggtttataagatttaaaagtttcgaattcgcctttattcataaggcttttgaattcgtcaggacgcatagctttgtcatcgataatccaatcatacactggtttatgtgtcagcaattcatggaatttcaaaccgatattagccaggttctgaagtagcccaggaagaatatcaactgcaatacgccctggtcctacagatttcataccgcgagcagtataaagtgttatatgatgcccttggtcataaagagcattaatagcggacaccatttcgatgtccgccttgaagtttgcataatcacggttatggttccattccgtgatgcaatcgtctacatcaaaacatagacgaagcatattttctacacgatgcattatcgaattcgttcccattgatgagtgatatcgccgccaattggtttatagacagcgccggtttctttatcgatgagttcccacttatcactgttctttgtaataagagttgccgtgatagcttcaggcaggtctttagctaccgtaccatctttcaacatacgtcccattttacgcagctgtttggtcagcaaatacatgccataataatatgacgaaaccgctttcaatgggttgttcttgaaataaccaccaagtgcaatccaaataatcgccacagccagatggtggtgttcgttgaacgtgtccatcttttcgtatttgtagattaatggctcgatattaacatatgcatgttcgccttcaatattcaaaccaccccataatgcatcagcattgaattcatcataaccacttacggcatataatacttttgcttcatcataaagacgaggaccataaatcttcgtgttaccgaaatagccacgagggtcaataaatttgatatcgccatcagtaaacgtaatcatcgtgttactgaagttagggtcaccgtgaataacatgatatcgtttagaatattgatacattgtcaaatggtttaaggcctgttttaacattggtttcaaacgaccaatcttaacaccattcacatgagtaatcttaccaaatgaatcaatcacaggttgaataattgcacaacggtcaagaactttatcatggaattcttttttaaagtcggcttccattttttcatgaggtgtgaagatgcctttattttcttggaaacgaagagcatcaagaattttatcaatcattgtgatgcgagcattcgacttcagagttttaatatgctcgaacattggcagcccgtggattcgctccatttcaaattcaccagcttctttattgtagttaacgatttgaggaattgaatccgaatggacagaataataccacttgacttcatcctcttgaagagaacgaccttgttccgttactgcaattttagttacagtatcttcgttgatttctacagaattaaaactacggttcagttcacggtctgcatgagcattagccagtttaggcttatcgccaaggtcgatgatattcatcaattcagattgacgcatagattcgccataaacgaaatcaacaaagtcacgcccttcacagtggtcattgatttcttctttggttatacccatgaagaattcccaatctttaaactgataaatgcctacgacattaccgcctgttgcgcctacgttacgaagcgaataaccatcgaaattataacgacattcatcaccttttgtataaatggcgttttcaccccaagaccatgaaccaaagtctggaataatgtcacaccagttcacgacaacattatgaccatctagaatagggtgtaataatgctaatgcataagccgagccataagattcatctacagtctgtacattaatcttcaggccttcttgttctgcataagcttcgaccatgtcctggaatttagaatgcacgacaacaataacttcatccgcacctaaatcagtataaatggtcgctaagtttttgagaatggtgtcttgtttatagttcacaagcactttagggatatgatgggtaattggatataaacgagtagccaatccagctccgagaataacagcctttttcattttgtgttcctcattaaatagtacatccattgtaccataatttaattgaagcaattgtatttggcctggagccagagcatacaccaacctatggctaatgtaggaatcattactggtacagtgatagaccagtaaattgttagcccaaagaaggctaacaaaaggaatccagtcaagtacttcatttgtcaccacggagcattgcgccaagtgaaccacctggatggaagcgcaggaagtcgtcaggcgtaaagttgcgggcggctgaaaggttaattgcaaaggtgtcaatcagagccaagagcagcgtcgtagacatcgtaggcgctaatttattatcatcaacctcgatagccttacctgtacagaaggtgtagtcgaacatcttcaggatatcagtactcaggtctgggttacaatgcagcagaatctggtttacgccaggacgaatgccacgcaaatggttaacaacgcctaacatctcttcagttttacccgaacgagagatatggactagaacatcattgggtccaatgaagcctgcgtcaccatgagaataatgacctgtattcagatacatacttgggataccaagcgaggccattgtttctgaagccttagtggcgatgttagcgtttttacctacaccggtgataattacacgaccttcataatcggacaaaccagggacgcctaggactgccaggatttcaagataatttctataatctttctcaactatagatgtcagaatatcaagagcttgtgattggagttctaacgcatttttagctcgatcaattggattaatgtggttcattacgttttaccctattacattcgttttcagttttaagagctttggactgaagctttgtgtagctctttttccaaaggtcaaaagctgtactgtattcataagatttacgataatcgcttcgtgatgggcgtttatcaataagtttattatattcttctttgaacgtatcattgacaaaacgctcacagtattctgcaatacgagtgttacggtcaatttcatggttcttggctacagcacgaagataatcctcacgtggctgtgcgttacgacgttcttcatcaagtttggcagccaattcggcttgagcagcacagttcttaccacattggttcggggctctggtatacgtaatgcctgtaccgttacgccattggacttcacctgtacgtgcgtcaacttcagcctgggttctaatctttcctacttcagatgcattgtagataggaccattaggcatctgacagccagtcagaagagtagcagctgctattaaagcaattttaagtttcatttttaatcctcaaaaagtgttaggccattttatcacagcccaacacatttgtaaacttagaaatcgaacatatcaaacaggcttgctttcttttcatagtcaattttagctgcatcagtgaaagcagttaaaggtttgacgaatgttttctggaacaacgtgttgtaatccatccaagccagaacttggtcacgaatctgaattggcaattcaattcctgaaggccatgcaatagacgtttcaccaaatgggttaccttcacgaagtggaagagtataaaccttttcaccgtctacaatttgtggaacagtgaggtcgcctttggttgctcgcatataagccaacacacctttgatatggccagggcatttatagccagggaaaccattatcattgtatttctgaatgttgtttgctgaagatacacctgcgatgctgatataattcagttcattgaattctttgttgaactctttgaaatattcttgcagacttccttcaccttcttgaagcatacgacgaatacattctttcagtgctttctgaacagcttttggagtacttgatttctgagtttcaagacccatgattttaagttttggttcaacgaaacgagtaccttccatgtcccatacgttcagagcgtaacgtttcttgccggtccagaaaccaccaataccatcagaaccaagtggtggtcctgcgatagcttctcggtccatgaacatcaagtgttctcggttgttcatgtattcacacatttcacggaagccagcatcaatagcaggttccatacgttcacgtgcaaacttatctaagaagtcgacataatggttcgtgtcacggaatttttccattcctactttctcaaggattttatcagccttcacataaatggagtcagtatcaccataaagtacgaatgcttcattttctgtaccaagagttttgttcagatattcattaaccttacgttcaatccactgcaatgccatctgaccaaaggttgtgatagccgtagcatttcgaaggtcataataacggaaccatacgttaccaagtgcaccataaagtgagttgataagcaacttacggttaatctgagcagtgttacctgcaacttcacaacgctcagctttgaacaacattgattctaatgctttctgacttaattcgtgaagtttagatttaacttcatcattgaagtcgaaacggtaatcaacttcgaattcaggcttatcacctttagtcgttttcttagcttctttaatcagctcttggttacgctgagcagccagcatataacctttatgttctttacgctgtttaaagaccttagtgatttcgaccggaactacaccttggaagctcttatcatacatcataccattcggagaacatgaatatacatcagatggacgtggagctgtaccagcaatatattcagccaatggatgtactttgaactgtcctactaatgtttctgggctaatattaacttgacgaatgatacttgggtacagagatgtcaagtcaaagctcattacatatttgtaagcgttcggaatcggttctttaacaaatgcaccaggataaggcagaactgggtgtgattgcatttgtggaataacttttttctggtctttaagtgagttaaagatgattgcgtcccatgttttgataggactaaacacagattgaatctgcattttagcataataacccattgacaggctcaggttaatgaactgtcgtttcatatcaatttgaataacacgataaacgtcgataatgttataactgatataacgttggtggtttgtttcacgcaacttagaaataggaccatcgtatggcagtttacctaccttcaattcaaattcagagacatagtccaaagaataagatggttggttggtgaaactaaatttcttgtacaggtcaatataatccagcatactgataccgtacagttgaataatctgacgggcaccaccatacatactttcaacttctttaatacgaacacgacggtgaggagacagacgtttagcagtcttttcactgaagatattcttcaaacggttatacacgtacggcacgtcaaatgcttcaacgttccaaccagttaaaacaacaggagttttctgttcccaaaggttcagatattccagaagaagttctttttcatcatcgaatggcatgtagacaattttgtctgcgatttcttcaggcagtgcatcaccaccttcttcttcaagtttacgagccagtttcaatgaccattctttgacattaccgtatggaccacctaaaaggtcaaacacatagaacttgtcatcgatagaatcataatgggtaatcgcatcgattggatgcttagcttcagctggttcagggaacccgtccggagatgttacctcgatgtcaaagtttgctacacgaattttagactggtcgtaatggatttcaccacgataagtgtcgctgatataagctaacttatagtcgtccatgcctaatgcttcaagacccatgtcgtccattcgacgcatccaatctttagcatcacgcatgcctgggaaagttttcttgacacaatacttgccatagatatctttatattctgtaggctcattagagtgcatgaacatacatggagcataagttacttcacgaacttgttcttgaccattactatcgatataacgttcgaagatactgtcaccgaattgttcgactgtcaaataaaattcttgcattgtttttccttttggtttatagtccgagtgattggactgttggtactgccattatactccgaaaaggagcccgtaggctcctgttgcttaaagttctaccgttcggcgttcaaatttagtgccagccgccgtaatagatttaactataacttgaatcactttaatttctggattaacaatacgttcgtattctttttgaaataaaatttgttgatcttccggaaggtcaaagagcgtttgatcttcagacagaccgtaatattctttcaatgaattcattatttcttgtctgatttctgggttcatatcaattacctattgtgtattttgatttcagtgtccattcatgtttttgtttgaaagaaataacacggaagttatttgtcaattctttcatgaatgaacgttggccttgagcaatttcaatcagaccccaatcttcaagcagccatgtaatagagtcacgacgagtttcatcttcttcagtgaattcaacctgtcgtccgtccatcttcaacatttctttaaagtgaacgatgtaatatttttcttgcttatgaagaatatgacaactctgataaagaactttatctttattgttcgcaatacccatacgagtcagagtttctttgaccttcaagaagtcttctggatttttcagtttaatttcaatcatgttaccattccaatgctttctttttcaaatctttttgttctttaacattcttggtcacgtcttttaagaattcgtctgtgacaagccctttcatcttcttcaacatcgcaggaagatgtcctttagctttatatgtagtgagatacatacgagcatcatcattgttgatattgtgatacttcataagaagtttaagtaagaatacttcattcacttcatcatcgtgggccttagcccacttaccaaatcttttacctttaggaacagaatgaagcaaatagttaaaatgactttggtcgtcaagcttcaaacagttagccattgctgcctgcataatacaatcaacatgctgacttagactattattcacccagaactgattatagttctcagaggcgttcaggttacgttgtttcttaccgaatgtgatatcgttcatgatagcgaacaattcattctcagctttctctttgaatgaatcagctagctcacgaatcttatcttcatcacgagacttccaagcaatctcgtgttcgttcagttcaacatcatcatcaaaaagacttacagccattggagctccagagcaagttggatgaacaaataggtcatgtgaatttcagggttagcagcgataccgtgatactgattattttcaccgacaatttcgtacattctaacaatgcttggtccaggcaatttagtataaacgtcatttaccaaagcctgtaaaaagtttgcataatcgtttacatgtcgtggagctaatgaacgaagagttttaaagtctttagctttcaatgcatcaacaacatcatcaataggagtacgagtattcatcacaatgctcagaatacccgcatcaatcttacctgactgactatattggtcgagaagattaacaaccttgcggaagtctgggaagttgtgcttaaccagggcaccaatgaccttaaggtcttcaacttcaacttcttcgtttttacagatttcaacagaacgacgaatcatttctttcatcatcgaattctggtctgcaggagttgcttcaccaaacgtaataacacgacaacgagattgcagtggagtaatgatgccgtcaatgctattagctgtaataactactgaacagttagaagaatatgcatcaataaatgaacgcatataacgctgggattctgctacaccttgtgaatcatattcgtcaataacaattactttacgtcgaccttcaattgatttagaagatgcaaaacgagtcagttcattacggacaaaatcaatacggcagtcagaacctttaacaaagaacatttctgaattcgtatcattacataatgcacgtgcaacagttgttttacctgtaccaggacttgctgaaactaaaataaggttcggtacaagccctttagccacgataccttcaaagattttcttatcttcagcaggaagaatacattcagaaatagttcctggacgatacttcaattcccacatgaattctttattgtttactgtcaacatatcattttcctcagttagtttcacttaatactccaaggagaccgaagtctcctttattttaaaacgaatggctagaaccatcttccattgcaataacgtaagaggcttgagaaccttcaaacttagcagcgaactttttatctgcagcccacagatggacacgataatcagcaggaatcattttcaggttcgttttgttgatgatgaatttaaaatcaggaccatcatggtcaccaacaaccagagaatacagttgacggttcaggtctttatcttcaagttggttatgaccatcaataacgattttaccatctttagcacgaataaccagcgtatcaattttcagaccgttagaagcacgcagcaactgttgcaggtcttcacctttaagatcgaaaataaccttagccactgggaaaggaattttcttggctgggaacacaatagtgcttgggtcggccaccggccagaagattgttgaacgttggtcgcgaataaccagattggtttcatcttcacttacagaaacttcagcagaatcggaaaccaggcccagaatagacaggaagccgttcagatcatagattgctgcttcgaaatcaatttcatcattgatatctgcttcgccataacttgcacctgaaacagaacgagtcagaattgtattacctggacgaagcataataccagagtaaatggaagagaagtttttcagtacggagatagtatctttagagaatttcatttaattaccttttattcaagtcagttaattatacaacagcttcaattacagccatttgtttcttaattgcagctggaagagattcgatgaattctggaatactcgcagcaataatttcagcagcctgaataagttgttcatctgcatcaacacaatattcatcttcaagacgatcagcgccaacagagtccattacaaacttagcaccagcagctacactgtcggcaatatgcttacgcatgatttcgagccatttttcatttacttcgtcatcaatagcttcataaagcatgaatttagtttcttgtggcagtgattgcagtcgagtagcagaatcagcgtcacaatgcagaacccatgcacgacgaattttgttttggttgttagggttggaatcggtacggacgtttttaggttggatatcacgagcggtaatgccgattgcagaagcgtatgtcatattatttctctctaatcaagttattcatttaacgtggtaattttaacataagtaattgaaagcattcggattaagctattcaattacttattcacttacttattcaaaatactcatagacgaaccatgctgtatttcttccagacattatcttatcacactcgtcaagaaaagcatctctcaacattttttcagtaacaagatgataagtctcgttgatattgtttactaacacatatcgttttaaatcaggggcggccagtaagtgctggcctgttgtaaattcaattgccattattccatcaccgtgaaacgacctactttcttcatttgaagatgttggccatatgcctgtgggtcatggtctctgtgactaataatgaaaatgttcgtatctttaagactattaagaatcataccaatagttttaacaccgtcggtatcagtagccgaatcgaatacctcatcaagaatcaacgtggatatattaacaccacttacctgagaagcaatatcacgccatgtaaacaacagagcgatatcaatacgagccttttcaccttggctaaagctaaaatagctaaagtcttcacgaccacgagatttaatcgtttcgttaaattcttcatctaaagtgaatacataatctgcttccatgattttcaagtagtggttaatcttcttgttaaacattggaatgtacttcttaattattgcacctttgatgccagaatctttcaacatctctgtcaaaataccacgatggtatttttccattacgagcgttgttttttctttaactaatttatcaagttctacttgaagcttagcaatttcatcagcatgactaatgaattctgcggcggcctggtcaataagaactttaactttcttggccttttctacagcagtgattgcagtagatttatgagcctgaatttggttcttgatttcacgagctttaccttgttgagcatgaacttcatcttgaatcaatttcagctcacgatactgtttgtttattttatctaaagatttttgaagctcaaagtttttgtctttaattttagtcaagacattgccatgttcttcaagcccctgcatacatgtaggacaatgtccaccgatctcataaagcttaacgactttatcgaatgtcgcaatttgattcttgatactgaatccttcattgctcaggtcactcaggcgagcgctagggtcatcatcgatgataacggcaagtaaatcatcagttaacttttcgatgttcgccttggccgccctggcttcacttactaagtcatcgtacattgtctgtaaacgagcagcattctcaccagataatttcttctgacgttcttcgttgtcattatagattttaatctgttgagtgataccatcctgcttaacatcaatcacctgaatctgagagttcgtctcacgaatcaaagatttgttcaacttatccatttcagccagaatacttacttcgagcaaatcttcgacaagttttcttcgagcgggagttgataatcccatgaacggagtatatccagccgttccgagtacgacaacctgtttgaagcttgaataagacattccaatgagctgctcaaactgttcttgaaagtctttggcggaggcagattcgtcgagaggtttaccgttaacactgatttcgaagacatttggtttttgtccacgtttgatgtaatattcttttccatcaaattccatccagagttcgaccaaaaggtctttcttgttagaactgttaacgagctggcctttcttaacatcacgaaatggtttaccgaataaagcaaacgtgattgcttcaaggaaggtcgatttgcctgcaccattcttaccagttacaagagtcttttggaccttatcaagttcaatagtgatgggcgccgcgcccaccgacataatatttttatagatgactttctttagcttaaacgttttcatgtattattctcacgaattgtttgttcagcatattctaacatttcttcagaagaagcgaacacaccatcgagttccatggcccatgaaacaccttcagaatattcagatgtcacgtacatagttcctgtataccaagaaccttctaccgtccaatctatattaccaaaccagccatcaccaatatgaaattcatgattatacattttcgctataccattcatctttaataagggtttcggctaattctaatacgtaagtaggagtatcatctggatatgcattaaaactaaactctacacccatgtctgtggtaacatgataagcttcagcattcaattcatcatcgaatttagcatcaatactatatttgatgtaaaaagtacagtcaagatgttctacataacagacgtgctctttgtgcatataagagcccatgaatacatcatatttcatttactcacctcaatataaagttgtttagctaaagacttcaatgatttacggtcctcatcagaatgaccatccggaagagcatcaatataatcttccatcaaatcaagcaatgacttgatgtcgacttcttcatcgctatcattatctacactgtcatcgaccttcgaaacaattctaagagaatgaactactttttcgagttcactttcaaacttaggtagtcctttatcaacttgctcaacaatgacacgaactgccagatttttaaattcgtcgtaattgattgtttcgttgggataactaatcttacggtgccatgttgtagaatttgggacgaagtcaaacgtcgctttttgagtgtcctgaacccagaatcctcgaggatcgttttcgtcgcctgctgtaagcgtccatggtgtgccgatgtatttgacattagctgcgctagagattgtgtggaaatggcctgaccacacttgtttgtattttttgaggaagtctggttcaagcccatgagatttcattcctttatagaaatagaagccgttaagttcccaatgtccaatacaatattcagcagaacttgtcttgatgtgttccataatttcggttgtgttttcgtcacacatccatggaatcaaatcaatcaacgtaccatcgaaatccatcgaaacgggtttttcgataacagtcacattagaatacttaccaagaacttcttgagccgcattaggagtcaatgtgttcttgtagtgcatgtcatggttacccacaatagtaatcagatgaatacctgcttcagccagttcttcaataatctgccgagcgaattccatacacttgtgtgtaattgctttacgtacgtcgaaaatatcgccgtattggataataattttgatattgtgctttttagcataagcaatatgctcacgaataccctttaattggatttcttggacccatgggtcatctgctttcacacctaagtgccagtcaccactgtgaataatcttcatatatcaagcgccgtcattgcaatacaaaataaaattattgaaatgaacccatcaggagtagaaaagaatcctatccaacaagctcgtgtaaatgtgtagaatgccatgagcaacacgacatatcctaaaaataattccataatgttctcctcagttggttcattataatctcccgaatgtatagcagaaaagggccgaagccctttaaattttcttgtacgtgattgtaccttcggctttagcctttgccaacgattctttgaatcgtctcattgcttcaaccttaccggcacgaaccttttcataatcaggtttagatgagttctgtgctgatgaagacatctacatcctctgcactaacaaagaattccgagcaatcaggttctcttaccattgataccaccttttaaccataattgtatcaacccaaacaacttctttaggattaaccttaatagccgggcctgtgtcacccaggacacgatagtgggtttcggataacttgacagccataacaccatcagccacagacaaagtgaaccctgcgttaaccttgagacgcttaaacggtttttgtaccagcattgataatattccagatttgttgacgagtagtttcccacatagtgacaatcatgtcgtcggtgtaaggttgacgatagattttacgcaactttttaattgcatactcatacgccggataattattttctaatacagcaccttgagagtgcaggtccaaacgttgaatttctcgtttgttctttttaagaattgcatctgcctgagctgtcgcttctttagcatttgcttcttctaaacgcttctggacttcttcaatttgttcatcggtcaattgagataggctgtcaatcattgttattccttaggagtcaattcaatatcgagatagaacaaatcatcaattaaatgataagaatattctacctcattttcttcactggtcaattcaacgcgaccaggatttaatgggtcaattgaaatcggtaaattttcaacgtctcgtaagtacatcttaagcaaatacggtaatgctgatacgtcgtcaccgatttcatctagaaacccagtgaggttaatttgaagcctcatataaaaaatccaattcgccttctttaggttcgtcgctcttatcagaccctggcgtcttaattaaagaagtttcatactgcgtcattttatcgtagatatcttggatgaatgtttcatccgccatgcctacaatatcatcgtcacctgcgtcatagacgttatggacgaagtagctgtatttctttgccatttctttacgttcttttttgatacgctgaacgaaggcattaaaacaagccattgttatatacgcatgtgggttatcatatttcgtttcatcgaagttatggagacctttaatcgccgcttcgatgccgtctgcaatcatttcttctttccaggattgggtatatcccgagaagttgaagcgttttgacagaccttgtgcaatgagcataattgctaaaccaataacatcattctgacgaacgattttgttagggtctttattagctcggagcttttctttccattcggaaatagcttttaaaagctccttattatttacataattgtttttggtcagacgtggttgttccatataagcctctttactcaattcataggtccattatatcataggttgaaggacctgaatttaaagcatcaaagcttacgaagaatctggtacatttcaaacagccgttcgcagatattcaagaactctttataactgaatggtgcttcagtgaagccaatttctttcacatatgcagtgagctcacggtacaaacgttcataatggctatggttcagctcagacacatgccattgataactatcatcggcttcttcatatgggataaaatatactcccatataactatctacgacaaattgtactgtgccatagtctaaagctaattggttacgattcattctagaacatccttaatataatcaattgcattatagaccgtcatgaaagcatccaggaaaacgtaggagtcgcctttaatttcataaaggaaccatgtcccaaaatcttcttcaatgatatacttatcattctctacgaatgtctggccttctttatttgatacagaataacctaagaggcggaggttagcgatatcatctggggttaatttagtcattcagatattccttaaattcttctaaattcatcccttcattccatgccacatcggggtcgacacgagtgtattttgttttagatgcaataggatagatacggaaatctatacccatcttcaaaacatttttaagtacacgttctaaaaacacagtttgagttatctttctactcagttcatgaaaataatgggtttgcttttctggtggaactttatataccaggaaaactgaaacaccttccggtaataaggctttaagcttattcatagtcaaaatattcctgtaattcagaaacagttaagccttccatccacatttcaccgattgttggttccttccaatcatatttgtgttcagtaccatccattggtcgcgggtagatacgaaggttatgaagcttaccttctacaaataactggttaagttcaatagggccgatataaccatggacctttgaaacttgtgaatgccaaaagcttactctttcaagcttcagaacaacaaaccgagtacctaccgggcatccggctaaatttaaggctgtcattagactgctgccttaacaattttgaggtcacggaagcctttcttacgctgagacttcatacgcttgatagtcttttcagaaatcttaccagcctcagggtcataagtgcctacaccgaaagcaggagtactgaattcagacaagatatatgctacaaccagttcacgaatacgagccttaccaatcttctggtcgttttctttcatagtaccatgcaggtcattttcccactggtcgaggatttcaggcgtaacgtatccaccagatttcatgatgctaacaactttgtcataagcgaaagagttcagaacgtttttgatagcttgagacatagcaatttcctcagtagttaatattttgttatccaaggaggacattataccctgtcctcatgggtttgtaaattaattactatttttgaaaaacttattagctttacgttttgaagttcggcctgttaaatcactgcactggttttcgaaattcttagtagcacttttattgtcattgcgttgttctcgacgctggtcttttttcacatcactgctaacaccattccagcgcttaggtttatcagaatggaagatgttattagcaactgtgatatcagaaactccatctggagctttgcgacgacctgcccagtattcacctttaggatttaaatctttacgacgaatagtcttacccattttaattccttatcaattaattttattgattggaggacattataccctgtcctcatgggtttttaaactagaaaattcttaagtggcgattaatcagccaaccaagatggtccgcttcgatttcagttatcttaataccgatttctttaaagcgattttggagcttcagtttgtcattacgcttaattaggaccactttaggaccataagcgagttcagcaatgtagcncattttcaggagcagwwstcgmwartgkkmykaargctactttttgttgtgttactatcttcatacacactaaaaggagataaaaatgactatcgattcaagtgtttacattcgccgcaacaaacttcgtcgtatctttgaaacagagttcgccgaaatcaacaaatct

SEQ ID NO: 17 - DNA, 35703 bp, Unknown
  bacteriophage genomic DNA
gtgttcatgcaatctcacattacctatcaaaccggcagtgtcttcataaaggaagaacgcatgacccatatttgcattgctaatgaagttatctgacacatccactcgctgcatttgcctgccgttgaaagcagaaaggtataccccacacgcaccagaaacacccttccacttattaccgctaatcttgacatcaaatgtatcggtattcgctttaaatggaacattacgcggcacggagtacgtggcccctgatggaactgtggctgtccattgggtttcaatagcaatggcggccctgctggcttcgaaaatattatctacgatcacaccaccacgaagtgtttcgccatgcacaccccaaacccagtcgcctaacgatgtgttcccctgaatgtgtaattcctcgacccattcaccaaattgaatagccgaatcatctccaccctgagcggtgactactccactatagatatagttatctgtgatttttatccaacggcaataaccgaatactactgcggccgatccagcattaagcaacatattgttatgaatgtggatacgctgacacattctcgataagttgatattacgatgagacccaccaactaatgtgttatcgaaaatgtcgaccacgttacagccgcgaatatggagattatgggtcccacctataacggtattattgtagatcctggtgtattgcacacttggagggtatgcggcccaatcagggcctccagtctgaccaactactggatcagcataattactaaaagcgacaataccattacgtgttactgtgccaacaccgccgtctgggtctgttccaactgttatgtaattgttgtatatgtcattataaagattgtcgtagccgttgtttgagatgccaagacggatgccgtagcactctggagtgtcaacatcaaggaacgtgcaatcatgcaccttacagcgacgagttccatcgagaactacaacctgacgaacttttttgttcgtcgttacataaacatggtgaaaatcaaccgttattctcgcgctgctcgcagtcttataactaaacagttcagataactcaccagaagcggttggacgaatgacgtccacattcatgtaagctatttctggttgattaacctgcatccacaatgtggacgttacgccatatgttttaccactaccccatacagcaatttttaaatcactacccgcctggaaagctgcacggatcgccagagtatcatctgttaccccatcgccaacagcaccgaacatttccggggtgatatgagggcgcatttgggctaagttaccctgaggttgaacccctataagcgatgcgccagttggttttgccagttcgataagaacgtctgatgctgagcctgattgcggaacaacagtaatcggctggcccaatgcgttaaacgccagcagtttgttagctcgctgatctgcgggtggcagaattccgacactgctctccggcaccctgagcgcccggaccagactgacgttatctacgtaatttttagtggccgcatcctgtgcgtcaacgggatttgccagaccagcgatacggtaaccttcagcattgaatggcccgccgagtaatggtctgcgtaacgcaagaccgaggtagataaacgaacgctggattgccatccacaggcggtcgaaatctttgttcaccgtgtctgcgagcaggtcgccgttatcctggtaatcagttaatcgataagtgggtacgacgcgctccagcatgacaacggatccgctggctggtggtgtgataaaagtgacatccccgccaccgacatttcctacgcctgagactgaatatccgctggtgacaacggtgccgttaatactgacctgaatatcaccggcgttgatgatgtaaaactcgaaggggaacacggtcgtaagaccgttggcgttataaataatataaggcgtctggttgggtaccgacatgatgcgaaacctctggcgggttaataatcgacgtcgaccagatgatctccgtcacttaactgccaatcttcgcgcgcatgcccggtcggaatcccgaccactttaccgatacgtacaggggtctgacttattgcgccagcacctgagtcgataaagtcatctggctggttggtcagcgcagggttaaagtcccgcatctggtcatatacagggccgtccagcacgtcggtatgcgcccacaggaaccgggacgacagcggcgcttcaaacgcatcaagaatacgtttctgcttgttggtgatgctgaattcttcacgtacgccgcaaccggtgcctttgagcgcctgacgcaataacttaccggcgaagctgccggggccgttcacctcaacgcacacaaccgggatctggtatttgagtaccagctcttttatctgcgccacctgcccgccggtgattttgtcgttatcgtcaaattctgccagctctccggtgagttcctgacaaatgtgccagtacagatgcccgcgtgcatccgtcagcatcagagagaacgccgaagcatcagccttaactttgcctgtagccacatcccaccaggcaacggcaccgacgatttgcacgttacccagccagagcgaggccgtacggtttgcatagcggatctgagggtgaatgttgtattcgcggatgcggtcaggatcgagacgaacatcgccgacaggcttactgtgcagctgatactggctatcccactcgttgatcgtgcgcgtttctttgcggcgattctccatttcctcgcgtgtgaagcgctcaggccaggcgcaatccgcataaaaatcaataacggtatccggcgcggacgcaaactcgacgccatcggccgtaattttataatcgacatcagcaaccagcagtctggcgcttttatggatccctgcgaaaacatattccggcctgaaagatagcttgtagcgcagctgcgttgcgtcttttgcctcgatgcgtttttctttctcaaacagccggatggtaagacagtcagcgcccatagactccacctcatcgtaaaggctgtcatgcgtgtgtggcgtaccaatgtagagcttgcgaccgccggggatcagaatgtgcgtttgttcccccaggcgatagcgcagcttttcacgcgcctccggcgtctggatgttgcggggtacctctacgtcatcgttctggcattcgttggcgcgggcggaggtaacgttagaaagaatgcctttggcgtacatactgccgttacgtaaatccagcgcaccattgacccaccactgctctaccgtgccctgcccatccggtagcatgcctttggtcagcggatggttgcgcagaacgttctgggtatctcggctggttttatacgcggtaccgtcggattcagactggtgcaaaatacggtactgtcggtcgcagtagtaccgccaggcattatagactgcgaggattgttgatttaccgaacccacggaaacagcgaagcaccgcgagattaccgcgatgctccagccagtggcaggccttatagtggcagtccggtacattccactgcatccgttccgcccacatgagaaagaaggcgaggaaggaaatcattttttccctttctgcaggcgctcaataattgcggcggcctctcgctcagctttcgatacctgctgacccagcgcaaaagcttcatcatcctgcccggggttatcagaaggcgtaccgccgcgcgtctgcataccgataagagaatgcactttaatcagcagcgtcagcgatgctgctgcgtttttcttgtcccagtagcggtcgccgcgttcgtctttggtcagctcgctcggtttctttcccgcccccggccagttatccggatcggcttcttcgagcaccacgtcggtgagtttgtcgctcagtgtggtaaggcgtgttttgtaatcctgatgcataaaaaagccccgtagtgaatacagggctatgatgaaacagtccagaggtcggaatcccgaccgattagcgcatgccggggtcgacctgatttatcagcggcgcaatccagaacaggttattccccggcagcagcgtacgcacgttatgcagtacccgatcaccggcatcgccattgagcacgccagcggtcacatcggtaatggtatcaagcagtccgaacgtagggccaagcgcggaaccgataaagccgcgactggcataacgtgactgtgttccggtaccgagcaaggccccaagccccaccataccgccggatgccttttccgccatattgttatattccattagcgggccaagaataccggagcggtcaatcccttccagtaccagtttgttcggcgaccagtccacctccttaccgtttgctgactgtttaagcgcgtacgtcagcgcgccgagtccaatctgaaaagcggtaccgtagtaaaactgaccggttccctcctgcaggccgcccagcgtggcacgattgtaggacgcggtagcgaacgatttaaactggaagatggttttacccagaggtgtactggcccacagtggcgtatcgccgatacccggtgtgataacggtattgttaacgtctttgagcaccgccgactggaagacgccagcaacgtgctgatcgtcccatttttcaaaattaccgatgtgccagccgttgattacctcaccgtgcttttcaaactcgctgcgaatacgcgcggccatattgtcgttaataccaagcttcgccagacgacggccagcgaacgcgccggagagaatgccgtcggacgtgatcatgccatttaccgatttgttcatatcatcgaagtggcccatcagcgtgagcttgccgaacgcatcagtaacgcgctccattcccgcttctatcgccgtagtgcgggcagagctgtctaccaggtcgcccatcgtacgcgcacgagtatgcaggatggtttccagcccgacggccatttttaactgttcggcgcggctggccttgaatgccggtgatcgggtgattaacgcagagtaaccgcgcatggtattaccaaaaccgttaaccatcacaccgcgcgcgaggtcaggtattgcggaaaccgtcatgccccccagcttggtgacaaagttagcgctgcgcaggaatgcaccggcacgtacaaaaaacgacgatggatcgtccggcatgccgtaggtacccgccaggcggtcgcgcagcgctgtgatatcgcggatatcgttatcccgggctttcgccagcttcgcctggtcttttggattctgtcgcatcagtgcatcgtattcgtcctgaatatccttgagctgcttctccagcgatttgttaccaaacgcgcgcgtaagctcaacctccgccgatgcctcacggatatgacgctgcagcacataattggcatcgctctccagataatctttcatcaggcgatcgggcacgctgagcgtacgcgaccgggtgctgcctgccgctttaaccataaagacgtttgcgaaatcctgaggaatttttgcaccgacgattttattgatcgtggcgtcagcagtaatttccgcctcttcgcgggacatggttttctcaccgcgcgaccaccagtcgaccagcatgtcgcggaacttatcacgctcgttgacgatcttgccgactttgtagacacgggggaaataactctcctgcccgatggctttaagctcctcgtcaggcggcagcaggccaagcttttgctgtgccactttcacccgattaactaccgtgcgcatcgcctgcgccgcttcctgcaccaccggattagcatgcacatcgccgctgcgcatggcgttgccaacttcctcgcggaactgtgaaaagctcaggtctcccccggcggctttatactggctgtaggcctgcttgttcgttaccacgacggccgcctcttcacgacgccacccgcgaacacgggtttccgcagcgatgggtgtctcaatgccgcgggcattgccctgcagtgtgtagttattctctgccagttcaagcgcggtgcggcgggaggttttcgacggtgactccatcagccgggtaaacggtgtcagataactccctgccttacgtgccagcttaccgaccggaccgccagctgccggggtgagatcctcaagcgtggcctcactgattcgcgccgcgccgacgctgcccccttccgggagtgaggcggcagccgtgtccgtcgctgacgtgatactcatattatcgagcgcgtcagccacttcacgcgtggccgctgtgcgaacagagggcgaaagcgcagcaccggcagccgcaaatacaccgctcattaacgcgccggctgcaacgtgggaagcgctttccccccacgtgcgggtaatctgctggttgttaagcgcaacctcgctcgctgctgttgcagctgcaccgattgcagcctgtgaggctatacgggcaactgtgccgccctgagcaccaggaataaacatcgacgcgacggtgacggggtcaacaaccccggcggcaatacttgcgagaacaccctccccgccagcctctgaaagtacccggcggtcctcgttttcgtcatcaatctgctgtttcagccaggccgtttcttccggcgaacgggaatctgcaaaagcggatccccattgttcataaccgtgcagttcgtttttatcagcatacgggttgtatccatctaccgcctcaaactgcttagccgggcggaacatctgccccagcaggttattctgacggaatgctgcaccccatacggatggctcatcctgctgaggtgccgggttggtacctgcgggcaaagaaacatcaaacccggttggtgccgccagcacattgcctgctggagtgaatccgttattcagttcttcaggtgtggcgtataccggcattattcagtgctccacgaaaagtaattttttaccctgtccatacgttcgttgtgcagacgcttatattgttcatcgagagcgcggtgtttatctttaaaccctcgaatatcctgaccgcgttgcagctcattgcgatcatgttcttcgcgctcttcctgcatttttttgtatggcgcccactcttcgagcgacggtttccagcgcatcggtctgccgtacgaatcgtagaacggctgtaccgcctcgattccatccttatcttttgtccgcaccatgatggcgtaatcgccattgcgggccgtcagcacatcaggggtaatttccagatcgccggcaattcgcgactctggcgttttgctggtaaccggtgctgcattaccagaggtgatcccaagctgcgtcgggctggtggtgatgtcgcccttgtgttcgccatacatcaggctttctttttcttctttccactgcgccgcctgccaccctgacggaccgtagttataaagcgcctcaggcgcatatttcataagctttgcgtcaccattaacctcgctgatactccaggtgcgggcgatctgctggttggtcattttcttcgctgcatcagcattgccgcctgcggtgcggtaattgatgtcatacagtgactggtaatcattgcggaatctcgcagcctccggagtttcgtcatcggcggatggattaccccagctaaagaagcccgacatgctgctcacagcggaatccatcgctttgccgcgatcttttttgtactccttagtgctctgggttgatgccagctgcgctttgagggcatcggtctggttgtaggtcagattctgcgcctgctcgatagcggtttcggatgccataccagaatcggtcaactgcttgacggtgagataaaacccctgcatatcctttggcatgtcgccaactgatgcgggatctgtgtcatacagacggttgaataactcagcaccctgacggaccgcatcaggactgcgcgcgcgggaaatcgccgataactgagtggttacctgggaaggaataatcccggtctgggcaacctgctgtacgatcccatcgtgagtagtggcgtcgttaatccggaagttttgcgccgttggcgtggcgtcggcggctttttgcatggatttattggtagggtcaagtttctcgcccatagacagcgcttctttaaaacgacgggcatcacgctgcgcctgtatcgcttcgttgcttttctgcaccagcgcgccgagcttgccatacgcgtcgagcttgagcgcataatcagggtcgtttgcctggggttttaatttcgcaatttctgactgctgctgttctggcgaaacgtactgtatcgcctggaaggttttagcgttgttgatcgcgatatcgagctgcttgaccgcctttgccccctggtcaccgtaagcaaacatgatagaagctttatccggcatagcgtcaggcacttcaccgttatacagctgcgccatggtgttattcaaaataggatcgatttgctcgcgcagggctgtgcgctgctcacggattttcgactcggcgatgttatcgattttgttaaccgacacaggatcgagaccggttttgtttttacggtaccgggccagccacccgcgagtttccgcaggtagctgccgaacaaaatcagcctcagatatttcgcctttgcgtgggtctcctgcctttgcgatcagcttgtcaacgttacccataccccagttatacgcagcacaagccagcgtttcagagccgtatttaccgtacagctgatttgcgtaatcactcgccagcagagcgttttgctcttcgtcagctgggttatattcaacaccgcgcttagccgccagctctttgcccgtgtccggcataagctgatatttcccctgcgcaccggcgggagaagtgataatgctgccgtcggcattgaaatgcttaccgccggattcaacgatcccgatggcgcgcatatccagcgcaccggtatcttttaccgggaagtcgccatttaaccagccctgaggattggtaaccgcatagttctgggctcgctggtccatagcgcgcaaatttgcctcagaaaccgcctggtcaatttgctcctgtgaccatccctgtgcctggccatacaacgaaattgagtgctgccgggcgctgcgaatcaacgaggctgcctgcggatcgtcaaacgcccccgcttcctgctcaacggaagattttaccgtcgcgtccagttgctggcgctgagcctgttcggtctggctacgttcaaagctgttgtaggtgctggcgcggcggatctgacctgctttccattgcgcgtcaaaatactgtaactggctctgtggaacgcgtttgcgagcttcttcgtagtctgatgaatccagcttgtccatgtccagaccaacgccagaggacttaaacccctgccgggttaccagcgcgccggtctccgggttctcccagcggtcgctggatttcgcatcgagatcggtaagtatcgcctgggtagcggccacatcagctttatcctgcgtacgctgcaaatcatccgcagtctggcccaaagcggcgcccagccccgctacagcattaccaatctggccgacattactgacaccaacccgggttggattcgcctggggcgcaacattgccaaaattacccgttggaattctcacggttatttactccctgcagttttccagccgttatacgcttttccgcccgcactaagcagagagctgcccgcgctgatatagccagatgttgaagcattccggccgctgattcggtccgcggacgcctgcgcgttgagccgtgcgctctggttcgtaccgttcagaatggtctggtacgcatcctgctccgcatcacccacgatgccggattgaatacgcaatgcggtaccttctccagtgtcaacacctgacgcagccagcgcggcatttgcctgtgctgcctgtgccctgcccgccttacggatgcgatcagcttctacgcgtgcagctgcctgcgcagcttctgcgtcggcttccgcctgcgcagcctgatagttggacattttcttttgctgctgcccgctataaacagcaccgccagctgcaagaacagatgctccgattgccgcaatttcgataccagtgcacatcgttacacctccctggaataaagcagacctgtacgggacaggccgagacgtgaatacaaatcaccagtgcgctcttcatgtacgcccgtggtgatacccatgtttatgatcgcggcaccgtgctcttccgcccaggtaatgaatgctttagcgagacgcgggcccgccgtgccgccacgatgctcaggcgcaataaacagcccgtattcaaaggccatgagctggcggctgaaccactgctcagcaatacccccggccagccagccgattacagcaccgtctttttctgccaccagcaaacagccggcaggcgatgaaataaggttgcgggcgagctctgcgcatttttcttcatcaaagggcgaattctgcgaataccgggactcgatatacatccgcgcccccagttcgatcagcgccgggatatccccggccgttgcgttacgtaccatgtcagcccccgttactggtgaacgtgaaaataattgcgagaaggtggaatggcagcggctggcgctgctgaataagcagggtatcttccccgcgctcccagccgagttttccccagtaatgatcgccggtgaaaagcggtgcaggctggttgaggatttttggcccgaagcggcggaacggtatgacctggccgttgcactctgccccagtggtttcgagaaaacgcatcgtcacttcgctggtgcgcttcttcgcgttctgtgtcgtaccctcagtagtctgaacttcaggagaaagcgtttcgatcgtactctcgaagtgaagaccaatttctacgcttttcgccgggcgtgacagggtgatttgaccagaggatacggtgtactgcggcataaccgcaccgtcggccactacatcaaccgtctggccctcaaggtgagcaagaccggaccacgtagcagaaccatcgctactggtgcctgttactgcagcatcggtataaagattgctgtcgaaaacttcgacatagcgtacggtctgaccgttaatctcacgacgtacgatcgcgtaaaccacatcgtcagtatcggatgggatggtagccaccgactcaaacgcgcctgcggtgacctgacgggaccacgcaataacatcctgagcgcgatcgatagccatggtgaccgcgacgccatccgccctgaccatccagataaacgcatctggctgttgctggtatgccatgtccagcacgccaccggcggtgatgtgctcggccagcaccgtcatatcgttggcggaataggaaacaaaactgtctgggtcgtacgctacggcgtagagcttacggccagcgcgctgcacaaacataatttcggtaccaacgcgcaccgggcggatcccgttgcagccatacggacttggatttttcaccgaaatattggtcggtgttatggctgcatcgttgccggaggtgatcgtaaactcgccgccataagtcagcgcaatcagggtattcatctgcgccagatgcacaatcgggttgagctggtcagaagacagcgtgaagctgatcgcatcgtcatcttcggtaccaatttcaaaggacagataaacgcctgtttcgctccaccagattgtttgcgggtacttcggcgaacccgccaggacaagacgctgctgatatagcgtaaccgcgccgggatagccaaatgcgtctgtccagactgtatcctcgcgcgtccacgaacccggtgacgctgcctgcgttgccgttaaatcgctgcgaattgtgccaactgcaatctgcgcactggtaatgctctttatcaacaccagtccgtcattaaggcggacatatgagcctacatcctgagcaacccagcccgcgccggtaaacggtggcgtttcgttatcaccgggatctgcatcgctaagtgtgagcgtaatttcagaacccacaaattctttgaccgacggcttacaccatttctgcggggtatcgcgtacctcgtcgaatggctcaacgataaacggagcaggctcaagcacccagtcggtttgcccgcggcgctggaggcggtgaggcttaacagactgatgcaccagaaacatggtgtcagcgccctggacataattcacggatggcagcatatcggaggtgtaagggctggcgacttcatacggtgtgctgtcttcgttgaccagttgcttaccgttctggtaaatgcgcatatagccgtcaccgaactccagcatgtaggcctgtgatcggttgaacacgtagggaataaggcgggattttttattgccgaattttgtggccgccgcaaaacgggttcctggcctacggacaacaccaccctgcacgaccaccaccgcgttttcaatgaccttcgcgccgttggcgtagcgagcaatatcaacacgccccatcagacgcggggacacttcgccagcggtaaaattggtttttatgaggttcgcgcgcatatcagaacctcgactcataagttgggtagccgccaagctcttccggcgggtcttcctgaccatcaacggctttagcctgtttaagcaggaatgcggcctcctgcgccaggctatcacgcaggctggcagagcccgtcaccgcatatgccagcttggactgcatcatcatttcggcaacatccaccagcgccgcgtcccacgtggattcgtcctcgttgcggtagatataacgcaggcgaatcacatcgacgttggacagcaaccgcgtgccctcaatccgataatcaatttcgtcccgtggttcgccgaccgacagaacgcggaccaggtcaccgggtagcgaaaactgataaccgtatccaaagacgggcgcagcactgacaggtgagagcacaacgcgttttatcgcacaattccacgggtgagcacggagcaatttattgcgaacggtagggtaaaggttggcgcaaagacgggcatgatccgtgtcttcgtcgaaatcatttatcgggtgagcacccagcgccagaagtgcatttgagcagatagagacactcgaagtcatggcagaacctcagatgaaaaaaggccgggggtataccccggcaaacacaccagcggcttaaacaacaaaatcgatggcgacgacttttttctcgttggcacggccggcaccataagacgcatcaacagagatctgaatggtgttgtttttatcgcgacgcggaccaatatcgacgttgtactcagcgccggtaccgaaatgcacagcggatttacaccacgcagctgcggttttggtggttacggccggatcgcctgcagtcgcagaatccagtttttcgtaagccagccagttgaagccgagccatttggaggacacagcaccttcctgcagcattttcaccgccatgaaatcggcagaagtcagcgtggtatcactgaggatctgcgtcagcatgtcggcgttgtacgtcatgtacagctcttccccgttctgctcgtcacactcgttacggcggaacatcgctttagcggcgatcagcttggctttggtcatgcctgtgccaccagcaacgattttttgcgatgcaggaagcgctacaggagcgaacgcgccaccgctggatgttttacgcagcactggatcgagcagcgcacgataaacaacatcgtcttttttgcggttggcggctgccagggtgagctgcaggtatggcccctgtgggtcggccagtagtttacgcaggtcacgtttttcaaccggaacgaatacaccgtagtccgccattaacgcattacgggtgcccgcttctggcaggtcccatacggtgtcaccgaaacgcgtggtgatctgcgtcatttcgatggtgcccatatcgttgatggtgaacgcttcgccggtgatcatcccacggtcatgtaccgctgcctgcaggcgggaatccttctgctgcgcggcgatttcgaaagaatcatgaaactgcgtgataaacgcagcggtgatcatgttcttattgacatcaaatggcataacaatcactccagaaaatatcgcctgctgggttgtcggttgcccggcccgattaacacaatgcgcgtggcgcttacgcactgcgggaaaattcagttatccggcgtccccgccgggctggtagtggagagattgttagcgaggtgtgcggtcggaatcccgaccaaatgaaaaagccagcgggtcaggctggctttttatgtatgcagaattatttaacggtcactatactgctggagttgcgagccaatcatcggcgaatagatcgccctgagaaggaacccagccaggttgcataacgccctgcgcgtttttcaggtcgaggtgtggcgcgatagtaaattcgccagtaatccccgccttcgcataatcactaccgggacgaggttcactgacggtatacccgcccgccttaatgacaaactggccttttccgttccaaccctcgttaagttgtcgtgacatgtcacgctacggtttggtcgccgtaacgcttctggtagtacgctttcaccgtcgctgatacacgttcatggtcggcgtgtttcgggtccatatacgccggggatttcatcagatcgcgaatggtctgctgctcttcgaggttcacatcgccgcccgccggcgcgtcctcctgcatttccgcaccgacttttgccagcatgcggataaccatcgggttattgccgatctcgtcaatacgtcccttgtcagcgtcgtcagccagcgaattaaacgcgcggaaagccagaccgatgttttgcttaaactccgcgtcggttttccacacctcgcgcagctgcgtggtggcggactcagaatccagcgctgcagcaccgcccaccagctcaggagcacgctgtgcgtattcacccaggataaagctcatctgatcgttggtgatacctttggcgtgcgcagttttcataaagctctgcatgcgcggatcggctttaaactcttcccagttaaacccctcgacctctaccttaggcgcatactcatctgacgttttcgggggtgcgtcgccgctgcccatgcgtttttcaaggtgagtataattttccgccagtttgcgggcagagctttcaatactgagttttccgtcttcgcccataacgcggaatttctcaggtatccagtcattcgcaccctgttcgcccgcgccggtgctgagcagagaattgccagaaggttcaccagcacccggattattgccgccatcttcaccacctccgttacccccgcccggctgttctgcgccgggctcagcgttcatgaataagtgtttaagcatccacatcgtcttctactccatcggccttgttgatttcgcgcaggatgtaatccagtacggatcgctgccctgccctgtaacatgtttcgcggtcgccctcggtaccaccggggacgtacgccgcacgcccaaagcggcgcgtcaattcttccagcacctgagaaccgccaggcatttcttcgaaaatgcgcttaaagtcctgaggcgtagcctgttttattctcattggttacctgccagtcgttgccctaatgccgcgccagctgtctgccctgcggccccagctgcctcggtgcccgcctgcatcatgagctgctgctgtgcggcctgctgctgtgctttctggcgctggtcgcggaggtctgccaccgcatcggatgagcgcatgaccttcgccggtacgcctaacgcttcgcccactacgcggctggcttcatcgctgtccatgttgtccagtatgtcggggtatgcctgcgccaactgcatgatgttctggccgtaacgctcgattgccgttacgtcttccagcttctgagcacgcgccagaggcgagatgtaacgtacgttgaaattggcgttctgcaggctctcaggcggtggggagaaaatgccagcgcggaaagcgatgccaaaacagcgcacaaccagcaactggagatattcagcctggaaccggccatacaccgggccaagcagctggcgaatcagcgcgacgcgcacgtgcacttcggttgcggtcatggctggcccgtcctgcggctgcagttggtcggccatcatgattttgcggattgatgcctgcaggcggtcttctgcggtaaacgctacttggaaatctgcaccggtcagcaatggtttcatgctttcggtgctgttcgccacgatgatgcggcgcgggccgaccttgaccgtacgcggattgagtacgccgtcgtcttcggcaatccacatgccggagatagccagatcctgagcggctttctccatgcgtttggtttcgttcagctctttgcagtcaggcagagcatcgtataccgggcctattccgtaggagccgccggggattttcatccagcgcggaacgcagcacgggaattcgtgatagccggattcgcgcacaacctgcttgttgctcacgtcgacgttgtacgacgcaaagcgcatgtttttcgccaggcgagcgttaaccatgtaagtttcgcgcgggaaaatgcagtgcaggaaatcaaatttatcgtcgggctttttcttcgccgcatcgcggatcttctcgctgaccttgtccgcgccgaattctttgattgcctgctctgcggtcagctggtagcggcggtatatcgtgtccacgatgccgtctttgcgggtggacgtgacatagcactgtgccagcggccactgctggaaggtgtagccgccctcttcccggtcctcgtcgatatacaggacgaaccagccagcgcagaccacatcgagatttgcctcgtatccctctgcgtcgaagttggcggcatggatattttcccacaccagcgttgcgcactcggaaagccaggctttggcgtcgtccggcagcgattcgctgtcgaggttcagccactgcgcgtttgccggggtcatgccggacatgagtgcagaggccagcatgcgggcgctgtcggtggcggtgccgtccagtagcttcgccaccttgtgttttgcgctctgagcgtcgagcacttcgtcagagaatcccgcgccgcgcagcggataggtgtagtcatagcactcgcgccagacgctttcatgctgctggcggtttgctttcagcgtatcggaacgcttaatcagcttaacggcgagttcatccatcagttacgcccccagagtgtttttctgctgcgctgcctgcgcaccagaggacagcagagagctgccagaatcagccgcaccctctgcaccactggcgagaagggacgagcctttcttgcgcttcttgcgcgctgctgcatctgcgtttgccgcttttgccgctgcgtcggcagctgcatccgcttcggcctgcgggtcggtctgtacgacctttggcgctccgcctccacacataacgattcccctcttagcccggaacgtgccagccgtgctcagtcagaacgggcttacccgtcaccggctggcgtttgccctcgtcgttcgtcacgtagctcagcggcgcggcaggctccgccgtggtggcttttttgacgagctggaggaattcgagattgtcggtcagctgctggtcagcaaggtcggtgtaacccagcgtttcaaagcgggcgatgatggccgcgccctgctcgttgatggtacccagcagagtattacgctctgcgagtgcggcatcgtccagcaggctggcaacgcgctgctggattacttcctgctctgcgcgctgattgtctgcgttaagcgtctggatctcagtcgctgtaaggcggttctctgcgtccgtctgctgctcagtgccggtttcaggctcctgccctggtacttcgacggttttctttggtcggcccattgtgttggctcctgtgatgattgagccgtaagtgtgaaacggggtcgcggtcgggatcccgaccaaatggaagatttgttaaaaacagggccgatttaacataatgaccgttacgcgcaccagcgaaatggcactcgttaacgatttagcatgaaggggttaattgttgcggtttactggctggaaatggtgaaaatggactgcataaatcatgcataaaacagggcggtttttgcatagcgtttttaaccaatgaacgccctgtttttgcaagttttcatggtgccagacgcttcgtgcgccaggcgtaaacaaaacgccgtgatgtaacctgcgctggcagttcagagcgcgggcgctgtgtgacgtagcaccagaaatctatcagcgcttcgcccgtgtggtggttcggtgcggcgccctgcttccagccgatgatagcagacttcgatacgtcaagctctctggcaatttcctgcaggggaataccgctgcgcgtgatgtcgttaatcacccggaaccagtccgttttgaacgttgcgacgactggcataggtcaccccccaaaacgcgcgcacgcgcgagcatagagagcgattttattgagcttctggcgctcgttaatcgccgtggtggaatcaaatcgtgtttgcatatcgctacctgcaataaattacatgttcattgctagaccacctgtgaccacctagaccgctattttctaacctttccccaaatcgacttatatatatatatggggttcttagtaaaaaggtggtctaggtggtctaggttggctttcgccttaaattacagtacgttgccgctagaccacctaaaaagtcgaggtggtctaggtggtactagttttcacccaaacgcgtatctgtttaccgcttacgaagcgcctatcccgtaaatatccgcagttttgcaaaacattaccgattcgcatttcttcgcgttttccgatattgcgagaatcaagaccaatcgcttctttcagtacatcgctagtaagtaaaaattcgcaatttcgcggaatgtcgttagtaatcaggtcaggtgtgtctagccatttctcgaccgtttcgagccacgcgtctttgatggtgtactgctcgtggacacttgcaccgagacgctcggcatcgcggaactggatgccaccgaggcgcttaaacgtctcgcgggcctcagcccacagcaaaagcaggtcggtttttatcgctttcacgtcgactttcgacacctccacggggagccagcgacggttaccggtcttatccgcgaggaattcgtcctcgttggtggtaccgacgaacaccaggcgacgcgggaactgggtggcaaattcacggtatttagggatccagttctcatgtgtgcgcgtcacgaatgccttgatggattcaagctctttggtattgagtccgcgcagctcgccaatctccgccaccagacgcccgcgcatcttgcgtgcgaggtcgtcgtctttctcagcgaaggagatctcggtgaagaaggccgggtcggggctcaacgcctcaacgccggaggatttaccgcagccctgaggaccgacgaggatcggcaccatatcggctttaacgccgggctccagcaccctgcccgccagcgcggtccacatgtacatcgacaccgcgcgggtgtaaggcgtgtcggcggtaccgaagtgcgtatggtaaaaagtttcgatgcgcggcacgccgtcccactccagcccgttcagccaggtagtagccgagtcgaacggctgttcgtcagcggccagcagtaccacgtcgcgaatgagctcgcgccccacgggtttaaagccgcgcttttccatcgtgatgcgcaggcgcgcatagtccgcatcggtgaacgcctgccactggccggagcctgcctgggcgaacatgatttcgtacggaactggtcaaagcggatatcgatattcacgaagtcaggacgcacaacggctttggccgcattgctgatggtggcctcgatgcgaccccacttgtcacgctcgaacgcaggcagcggtaatggctcggccacttcggtgctggtcaggtcttcaaaatcgtcgttgcggatcccgatggcattaaggaaatcgccgtcatcgcggtgcgcacagctggcgtgcaggcatttaaagtggccctgctcaaagcccgcggtaccacccgggaagtaaactgtgctggtagggtcgccgccggtgctgtggccatcctcaaacgggcagcggatatagcgctcaccgttggcaccatcaagcagcgtccagccattggcgtcgagatattcggctgtatcatccgtcgcgccgggcgtgaaggttgagcggtcgcgcatcttcgtgctgcccgcttcagtggtgaccgacacaggcagctggtccgccaggcgctgccacagcgtttcgagctggtcagcggtaatgactggcggctcatccggaagaccgccgtcccattcaatccgcgcgccgctgctgtgcgtaccgcaggcaacgaactgctgcccgttcgccagcagctcgataatccccatatcgcctgccagacggtggatgcgtttacggaaatcgccatcaacggctagcaggtacaggcatttattactgttggcgcgccagcgacgcggcggcagctcgcccaacagctgcaccagcgttttgcgaatatcggcctggatatcttcgtcttcgctgtcacagtccagcgccagccaaccatgacctgtacgcacgcagatgccgtaatccggctcgttcgaccagcgggcaaagtcatgctcggttacgacgtgctcggtccagtccttgatcccggtagccaaacggtcgcggttgtacaggcttggcgttttgccgagcattttgagtttgctattcggggatatggtcgcgcccgggttgcacacgaccggcagtagctggtcagtacgtcccagcaccagatcgaagtggaaccattcgtcaggcgtcgccccccagatctttttctctggcatgggttacgcctttttatcgttttgtgagccgtgcagcagccagttggggtcgcaatcaagcgcaacggatatttccagaaggtaacgtgggcgggagataacgccgctttcgatcctgttgatggcctgctgactaacccctgttagctcagccagcgtgacctgcgtcattttgagctctttacgtcgctcttttaatcgggtagccagagtcatagttatcacctcatacaattttagtggtatttagcaacaaccaatcatgtttgtcaaatacaacaaaaattgtatttaataataggaggtcataatttcaactcttacaaggtattaaaaatgtctctcgcaacacgcttcaaagcccgccgtctcgaactcggaatgacacaaacagaagtcgcaaactctgcgggggttagccagcaatcaattgagtctatagaaagcggacgcacccgaaaacctcgtaaccttctcgatctggctaaagcactgaaatgcagcccggactggcttttgaacggtaaaaacataatgccgctcgctgaaatcagcaccagaagaattcctgtattgagctacgttcaagcgggctgccttaccgaagcaagagacgttaccgacctcacaggagagcttgaatatgttctggcggatgcagacgtgcctgaaacatgctttgcgcttcgcatcgatggcgacagcatgcaaccggagtttaaagaaggcgatatcgtcatcatcgacccggacctgtgccctactccaggagaattcgtggttgccaagaacagcggccatgaggccacattcaaaaaataccgcccgttggggataggtgttgatgatttcgaactggtaccacttaacccagactatccggttttacgtagcgctgatatgaagctgcagatcataggggtcatgattgagcaccgcatttaccgtcgtaaacgttgaaatcctgccttctaaggagggcggcagagccctccacccacctatcttgtaaaatcttacaaactaaattcatttaaatatcaataacgtggtattcccacgccaataaataccacatttgtggtttacacaatacaactcaaattgtagatttaagcccaagaagtaatcgctctttaaaaaacagaaccgcgtgacaggtaagccgctgtgctcctggcaaaacgaaatggcacccgatgggatcgaggtaagcgccgagtccgtatgcgtacggtaagcgtagaggaccacaccgcgacgagctgataagtcacgcaagttgaaacgccccgatgatggggcgtgtagttccctttggggtgtggaagtttggttagcggttagctgccgcaggtaaaacgtcatggcgcgcgcattaacagggcatggagtcgcgggttcaacccccgcccacaccaccaaagtgaactgaatgaggaaaaacctatggacgattacgaagcatatttcgatagcctgaaagaaggcgaggaagcccttagctatgaagagtaccgcgccgctttagccataaccccttccatctgaatcatccatgtaattgctgtgtgtagtctttgcccgcctcccatgacgggcttttttcatgcctgaaagcgcattcagtgcagtgcgctcccctacatgaaaaggagcactaccgatgaaacctgaacacctccaccggctgacggggcgcgatgtgctccgctggcgtcgcaagcacttcgacatcttcaccggtctggccctcgctactgcgttcggcctggctattaccttcattctccttgtagcgaggaccgcagtatgagcttagaaaccagtctcgaacttaacaaccaactgctgacgcagcataacgccctgcttgaacgccttatcaccgcgctggcctccggcgtggctctccgtccggacacagtggcgcaggtgcaggaataccgcgaaacaataccggaaaccaaagcggaaaataccgttatccgcaaggttacgctggacgatctggagttcagcgacattatcgccctggctgcattctacccggacgcgcaggagctcagcgaaacgatggtccagcgtgttgttgattaccgcgacgccgaaggcgataagcgcgttgtgcagatcgacgctctggacagcaccctgcagggtgttaaacgcgctgctcatctgaacaagccagcgttacttgacctctcacgtaacattctgcgcttctgggatgatttaccgaccatcgcggcacgccgtgactttgccgagcgtttactggacgcaccagccgacggtcgccatgaagtgaagccgaaaaccagcggtaaggacgaagaacgcaccgggccgttctactgcaagaacgtcgatggctccgccgccagcgagctccatacattacgcaagctgaacgaactgcttaaaaagggccatatcgagatcactaaagttgagtacctccagctgcaggaagatttagcgcgtaaaaacgcggcagcggacacgcagacggaaactaaatccgacgaagcacttaccaatcggtacaaaaaccaacgaaaacatgctgaggggttaatcctccagctggcgaaaggtggttatcgtgctgaagctgtggcgattctggaaaaacagggtgccaaaaaactcggcgaagttgctgacgagaacctcgcagatgtgatcgcccaggctgaaaaagcgctggagggttaactatgccagacgttcatgcacgactttccccatcatcggcgcatcggtggatgcgctgccccggtagcctggcgctggaggccacgcaaccagacaaagaaacgtccttcgctttagaaggtaccgcagcgcacgcgcttgccgaaaaggtgctgcgaaaccgccagagccacccggaacactatgcaggttgtaacgttgcgatgttcctcggctcctatcctcttgctgagcacccggatgatacctccggcccgcaggtagacgaggaaatggtcgaagccgttggccgctacgtcgatacggtctgggcgctgtcgcagggcaatgagctgctggtagaacagcgtgtcgacttctctcacatcgtgggcgtagatgagtccttcggtaccgccgacggcgtaatcatcgcgggcaacgagctgcagatccacgacctgaaatacggtaagggcgtgcgcgtcgacgctgagcagaacgaacaactgcagctgtatgccctgggcgcgctcgagcagttcagcatgctgtacgacttcgagactgtgcgcctgttcatccatcagccgcgacttaaccacgtttctgagtgggccctgacggtggaagaactccaggcgttcggcgaacgggcgcaggaagcggccgccagtgtaatcgtgatgttcaatatcgccgattgcgaaggcgtcgaaaccctgccgctggaaaacttcacccccggtgaaaaacagtgccggttctgtaaggcaaaagccgtctgcgctgctcagaaaatgcagcacatgcaaactgctgcaagcgatttcgaagacctgacaaaaccggtcggtgaaatcattactgatgccagctcgcgcgtaccgcttctgaccatcgaggaactggcggagatttacagtcaggccgatgctatcgaatcgtggctaaaggctgtgcgcgaccgggtgaacagtgagctgaacgccgggcatccggtaccgggctttaagctggttactggtaaacagggtaatcgcgcctggagtgatgaagaagccgcccgagcgctgctgaaagaccagttccgctacaaaatggaagaagtcttcgacttcaagctgatcagcccgaccaaagccgagaagcttatcaaaaaggccagccctcgccgctggccgaaagtcgaagcgctgatcacccgcgctgatggtaagcccacagtcgcccccgaatccgacccgcgccctgcgctcaatatcaaccctgttaacgatttcgacgacgtgtctgacgacgcgctcgccgctgacctcatctgattaaggaacgactccatgaaaattaaactgaacaacgtccgtctggctttccctgctctgttcgaagcaaaaaccgtaaacggtgaaggcgacccgcgcttctctgctgttttcctgatggacccgaaacacccgcagctggaagagatccgcaaagcgctgaaacaggtagcgaaagaaaaatggggagagaagtgggaaaccatttacggccagctggagaaaaaactcaacctctgcctgcacgacggtgacgaaaaagccgaatacgaaggcttcccgggtaacttcttcctgaacgctgccaacaaagcacgcccggcagttatcgatcgcgaccgttctccgcttatccaggctgatgggcgtccttatgctgggtgctacgtcaacgcggtgatcgacatctgggcgcaggacaacaactttggcaaacgcgttaacgcatcgctgggtggtgtccagttcctgcgcgacggtgacgcgttcgctggcggcggtgttgcagcaccggatgacttcgacgatatcagcgaaggcgcagacgcttccgatctggtttaaccctttcccccacccggccatgcgccgggtgttttgcaaagagcgtcccttttcgcaaagcacctgcgaggattgagtatggaaaaattatggattgacctcgaaaccttcagcgaggtgcctattaacaacggcacccatgcctatgctgaaaaggttgaggtaatgctgatggcttgggctattgacgatggccccgtcagtgtttgggatttaacagcaggcaatgtaatgccgccgatgctgtatcaggctctgaccgatccggtaatcgaggtgtgggcgcacaattcacatttcgaccgtacggttatgcggcatgaccatccggagctggtccctgatgtaacacgctggcgcgacacaatggtgcaggcactggcgcacggcctccccggcgcgctgggggcactctgcgaggtgctgggcgtcccgcaggacaaggcgaaggacaaagaaggtaaggcgctcatccagctgttctgtaagccacgtccgaagaacagtaaactgcgccgcgccaccagcaaaacccacccggaagaatggcggcgctttgtagcgtacgctggccttgatatcgaggctatgcgcgaagtgcataagcgcctgccgaagtggaactacaagggcggagagctggcgctctggcatcgcgatcagcaaattaacgaccgcggcgtctgcatggatgtgcagctcgcgcaggcggcgatcgaggcggtagaccaggagcaaaagcgcctggcgaaacgcacgcaggttatgaccgacggcgaagtgcaggcggccacgcagcgcgatgcgctgattaagcacattgttgaatcctacggcgtggagctgccggacatgcagcgcagcacgctggagcgccgtatggcggacccggatttgccgtctgcggtgaaagagctgctggctatccgcctacaggccagcaccaccagcaccagtaagtacaaatcgctgatgaagggcgtgagcagtgacgggcgtctgcgcggcacgctgcagttctgcggcgcatcccgaaccgggcgctgggccggacgattattccagcctcagaacctgccccgcccttcgcttgagcaggaccagatagacgagggtatcgaggcgctgaaagccggatgtgccgatctgctgttcgataacatcatggagctgaccagctcggcgctgcgcggctgcatcatggcccccgcaggcaaaaagctggtggttagcgacctgtcgaatatcgaggggcgaaaactggcctggcttgccggcgagcagtggaagctggacgcgtttcgtgagtacgacgaagggaccgggccggacctgtataaactggcctacgcccgcgcttttaatatctcgccggatgatgttgataaatatcagcgtcagatcggcaaggtgatggagctgggcctcggctttggcggtggcgttgcggcgtttcttaccttcgccctggtctacggcctcgacctcgacgaactggcgaacgccgcgctgccgaacatcccccgcgatgttatccgcgaggcgaaaagttggtacgacgaatccgttaagcgtaaggcgacctacggcctgtcagagcgcgtattcatcgcctgtgactcgcttaaacgcctgtggcgcagagcccacccggcaacctgcgatttctggtacgagctcgagcgcaccgtccgcgccgcaatagccacaccgcaaaaaacgctgtactgcggttatctgaaagtccgccgtgatggtgcatggctgcgcatacagctgccctccgggcgcgcactgtgctacccgtccccatccatcgagaaggggaatatcacctatcagggcgttaactcctactcgcgcaaatggcagcggctcaaaacctacggcggaaagctggtggaaaacgtcacacaggcggccgcccgcgacgttttggcaggaaacatgccgctgatcgaggatgccggttacagcattgtgttgacggtacacgatgaggtgatcaccgaagcgccggacactgacgatttcaacgatatagcgctttccgcgctgctctccactaaccccgaatgggcgcccgatatcccgctgaacgctggcggcttcgaggcgtaccactaccgtaaggactaataactatggctgtaataaagacgcataccggaacggttattacccgcaccggtgaaaagcaggtgcaactgcatcaaaacccgacaacgtgggtggctggcccaaaagagtattactacaaagacactggccgccgcggtggtgctgtcggtgtccgcactcgtctggtgctgagcagcatccgccctatcgataaaacagaggatcaacagcaatgacacagggcaacatccaaaacttcgccatcatcgtgctggtaaacggcggtactaagcaggtctttttgaccaaagagcaaaagcaacttttcgcaaagctcaccctgggagcattgagcgacaggccgatcaccatgatgcctatcgacgatatgatccagttgcagcctgacaccgacgcattctcttcctgaggaaatctctatgtcatttaaatatcgggacagtccgctttattaccggactgcgcgggaggctttgcgccttgagcagtccggggagtacgaccgggcggcaaaagtctgggccaaagccaaccgcgaatcacgtaacgaacttaatcaggactggagcgaacgccgggctgatttttgtctgatgcagaacatgcgtgaaaagcgtaaggcggtggacgagtgaaaacagtaatccgtgtgattctttgggttggcggtatttctctgtttgctctgctggtttgttttgccggtgagcacgaccgtgaagattgcgaggttcgcattgccaaagaactgaacactaccgccgtatacatcaacggtcattgcatggtcaaaggctacggccgtttcgacgggagatagtgctatggcctacgaacgtgaaagtcttatcgaaaagcacctcgtcgccgaagtgaaaaaagctggcggggtcgcctttaagttcgtgtcacccggtcgccgttcggtcccggatcgaattgtcctgctacccggcggccatctcgtctttgttgaatgcaaagcgccaggcaaaccaccacgcgccgaccagctgcgtgagcacgaacggctgcgcgcgctgggctttaccgtggtggtgctggatagcaaaaatctggaggagatattgtgcggggagcctattacaacgaaatagactctaacgcagcgcaatggctgcgtaatcttattgccgcagggcatatcgccccaggtgaagttgatgagaggagtatcgaagatgtcgcaccagacgacttacgcggcttcacacagtgccatttcttcgccgggatcggcgtctggtcttatgctctgcgtctggccggatggccggataacaaacaggtctggacaggaagttgcccgtgccaacctttcagctcggcgggtaaaggcgctgggtttgatgacgagcggcacctatggccagcactattccacctcatcagcgagcgacgccctgagctggtatttggcgaacaggttgcgggagtcaatgcctggttcgatcttgtacaaactgacgtggaagcagtggactacgcctttgggcttgtcccgtttccggctgcgggcgtcggtgccccgcatatccgagacagagcgtattgggtggccgacgccagcggcgagcgaccacagcggtggcggaagcgcctcaatagcactgaggaagatgtctggagatcgtcgaccatccggcaatcccttacacagctccctaagggactttgcccacctggcgggatggtacacgccaacctgcaacaccaatccacagccggagaccaaacgcggtctggaaaccttagcggggctatccagacttgcgggttggccgagtcctctggcgagcaataccaaaacggcctaccaagatgcagagaaagtaatagcgcgtcagcaggcaggacggcagccgaatctgcaggattatgcctgcctgagcggatggccgacagtgacgacgatcgacaacaatcaagttcggggcgagggagcagcggccaatcataccgaacggggaacgaccctcggcggtgcagcgagaatctgcggcccaatacgattaacggctgctgggatgatgctgactggctcctctgccgggatggtcgctggcggccagttgaacccggcacattcccgctggctcatgggattaccagcagagtgggacgactgcgcgcctacggcaacgcgatagtcgcgccagctgccgctacattcatccgctcgtttatggaatgcgcaggatatgacctcatctaaaattttcacaccccgcccttaccaagacctcattatcaaccacgaaatcgacaccctgcgctgcaacatctgggcgggcatgggcatgggtaaaaccgtggcgacgctcaccacgctggaagatctcttcatggcaggagcggagacacggcccgcgctggtgctggcaccgcttcgagtggccgccagcacatggtcggatgaagcggtgaaatgggggcatctgaggaatatcgaggtgcagccgattgtcggtaatgccaaagcgcgcgctgcggcgctggcaaacagcaacgccagcgtgttcaccattaattacgacaatctggtctggctggtggaagaactgggcggccgctggccgttcggtaccgttatccccgacgaaagcacccggctgaaatccttccggttgcgcgggggcggtaagcgcgcggcagcgctgggcaaagtggcacataagcacgtccggcgctggatgaatctcaccggtacgccagcgccaaacggcctggtggatttgtggggacaggcgtggtttgtagaccaggggcagcgcctcggacgcacatacggcgcatttacctcacgctggttcaactcaatacagtttccggggcagagctggacgaagctggagccgttcgcacactcgcaggacgagatacagcgcgccctggccgacgtcactatctcactggacgccgccgactggttcgatatcaaagaacccatccataacgtgatccgcgtggacatgccgcctaaggcccgccagcagtatcgcgagatggaaaaggaaatgttcctggagctgaacggcgagggcatcgaagcgccgaacgccgcggcaaaaaccgttaaatgcctgcaaattgccagcggcgcagtgtacacggacgatgccgggagctggtcagaactgcacgacgcgaagctgcaggcgctggacagcatactcaccgaagcagctggcgcaccggtgctggtggcctaccactggaagcacgacctggagcgcctgcttaaagcgttccctaaaggtcgccatctcgaccaggatccgcagacgctgcgcgactggaacgccggaaaaatcccggtgctgttcgcgcatccggccagcgcaggccacggtctgaacatgcaggacggcggcaacatactggtgtttttctcccactggtgggatctggagcagtaccagcaaattatcgaacgcatcgggccaacccggcagattcaggccggacacaaccgcccggtatttattcaccacattatcgccgccgacaccatggacgaaatggtaatggagcgacgcaattcaaaacgaacagtgcaggacatcctgctcgatgccatgaaaaagagaggtatagcatgacaccggttatctctgacactgacctgattaacatcaaagaggttgagcgctctgttgggctgaaaaaatccagcatttacgagcgcatcagcaataacgagtttccgaagcctaagaagctcgggagccgaacctcccgctgggtacgcggcgaggtcgaagagtggaaaaagcagtttctttaaatcaaacgcagctggtcaatataatccgcataccactgcatcatttcccgacgcccttccatatacagggcatggttataaaccccgcgaatattgttcttatccacatgagcgatctggagttcaacccagtcagagttgaatcctttatcgttcaggatggtgctgaacgtatgccggaagccatgccctactaccctccccttataccccagcgtgtggatcatcctgtttattgtgttctcgctcatgacctttgacgggtcattcctgccggggaacatattcacgtatcgacctgtcagaccgtgcaactccttcagcaagacaacaagctgatcggaaagcggcaccaggtgcgggcggtccatcttcataaattcggcgggtatctcccacagccgattatcgaaatcaacccattcccattttgaatgccgcagttcgtaagtgcgcagccccgccagcatcatgatctgcaaccccagccggggtagtgggctccccttgtaactctcaagcgccgcgagaaaatcaggcagttcttccaccgtcaggaaagggaaggactcccccttatggccggtcatggcgctgttcagttcgctgacggggttatacttcgcacgcccggtcgcaactgaataactgaaaacctcaccgcaccaccggcgcgttttggctgctttctcggttgcgccgcgattctcaattttgcgcaatgccgtcagcatctgaaccggttcgatttcagcaactggcagcttacccactgccgggaaaatatctttgttgaatgcttcgagaatgtcagaggcatagccaggcgaccagcgcggcttcttgaattcgtgccattctgtggcaatctctttaaacgtgatcgtctttgctgccgcagctgcggcatggcttttgacttttactgggtcaacacctgccgcaacgttacgccgggcctcatctcgcttttcacgagcggccgccagcgaaacagccgggtacacaccgagcgccagcatcttttctttaccggcgaaggtatagcgataacgccagtattttgccccactggttttcaccagcagaataagcccgttgccgtctggcagcttatagtccttctcggctggctttgccgtttcgacctgtcgcgcattaagtttcataggtacccgcctcaaactcagatacccgtttatgtacccgttttaaatttggattgcaacggtaaaaggtggataacggcggacaaacagaacagccaacaccgcgaaaaacaaggaaaaatggacgattggggatggtgctggatgaaatgatggtgccgataataggagtaaaacaaagcaaataactcactgtatttactttattttatttttatataacagacagatacccgaattgatacccgttttgatttcgctcccgactgaggaacaaaacaggctattccgtagccatgtaccacgcctgccagcgatagatgtttgtccgcagctcgcgcacacagtcagtcgtctgagtatccgcctgcaggtcttcgtcgctatctcgtccggcgttacttgccttgcacggcgggctcatcaaatcctgggatattgttggccgcgtcgattgctcgctgccgcagctgcacagcatgatcgtcaaaatcgcacttagtatgattcgggtcgttaacatatttcaccacgtcacggtaaatggtccggtaaatcacttttccctctgcgctggccgctgccgctttctgttcgccagtggcgacggctttctcagcctttttgctcttcgctacatgctcactatttaccttttcgctatgcgcgtaccagcctttcagataaccggcataatacgcaccgacaaacagccccagcagaacggccagcgctaacagcttcgctttaattgtcactggtctatcccccagcatgtcagtgcgctttcttgatcccggcgctcaacctgaccataacagccattcttctgacctttggtcaggcggcagtcgcggccaccgtctttaatccaccagcggatcgcctcgcaagcacctttgcggtctccagcattgatgcgcttatagaacgtcgaagggaaacattttcccgggccgatgttgtacgggcaaaatgaagcaataccggctttctgtggttcggtcagcggaaccttaatgttgcgctctacccaggtcagcgccttattgcgttcaatggcgtttacctggtcgcatttcgccttcgtcaacttcataccctgcaccacaggtttgccatccacagttgtggcaccacgacaaatagtccagattccgccgccgtctttgtacgctatgagactgtttccctctttttcattcaggaactgatcgaggatgaccgacgccggagcgccggcaagcaccagacccagaacagcggcgctgagtttagtcttgctggtagccattatctcgggcctcttttcggcgatcgtctttgattttgaaatacagattggtcagataagtcagcagaccaaagaggatactggcaagaacgccaatagcggcccactggcttggactcactttatcgagaagttgcagcagccagtacccaaagctgcctatagatgtgccgtaggatagccccgccgctacgtctgaaaggttgttcatcctcatgcctcaccccctgtggggaaaatcttgtagtgagctgagagtaagcgtggagaccggtcggaatcctgacctttatggttacacggagaaagtcgattacaaccagattagatgttatgctttgggagttatcttatccagcaatcacaacgggaattatgatgctcaggtctattcaatacctaagagccattgctgctctgatggttgtattgcaccacactgttagggcaaccactgtttttgaccctttcctgcctgattatgtacattcagcaatcaaacacaacttctcttttggtgttgacattttctttgtaataagtggatttgtgatttatctatcatatttgaaaaagccaaaatcagcttataactttgcaatggacaggattgccaggattgcaccagcttactgggtttactctgctatttttgctgttgttttaatttatttcccatggtcacatccagcaagctcatttgagccagtccactttataaagtcactggcctttatcccatcacagaatccctctccatttggcgggatagcacctacccttactgtagggtggactcttaactttgaaatgttcttttatgcatgcttttttgtagccatattgatcaagagagaagagatagtgttactgacatcattcatgatgatgatatcattcttccttccttactccgcaggaattaacactttttacagctcgccaagagtttttgagtttatcttgggcatgcttctcgcatcttattatttaaaaagcaacgaaagaattagcatccctatatatgtatcagcaccgttattcattgctgcattccttgccgctgttagctcaaaagcagatgatttttatgtatggatcccagcagcgttcacgattgttgcgatatctgtatcagcagaaaaacacatgccagaactaaaaccacttttagctgttggtgatggttcctactcgctttacttaagccacaagatatttatatgtcttggaataatagcgagtagaacatacggttacgaccctttatggtcaatcagtattgctgtagtggtatgcatcattctttcatgtttctcttatcgcatacttgaagtgcggtgctcaaaagctcttaaatcagcaaccgcaaagtaaaagaaaaggcggccccgtgaggggccttattttttagaagttacgtgattgctcaaaccacaggcctgactgtcgaactagttgaataatcccattagaatcgacaaagacagcattcgctgcccctcttaacctaaatttagttgtgtcttgaactaaggttgcgccagtagccccccttatagttattgaatctccgtctatatacggtccaagaacgttagttacagcgaaagcaccggagattgaaaacgatttcgttccataacccgcgacatcaccactaccagttatgatttttgtcagcgaagttaaaccagagacattgctaacagaggataatgcattgttactattgaatgagtagtttgccagttgtgctcctggtgcatg

SEQ ID NO: 18 - DNA, 174694 bp, Unknown
  bacteriophage genomic DNA
  misc_feature (110662)..(110663): n is a, c, g, or t
  misc_feature (174430)..(174500): n is a, c, g, or t
taattcattgcgatactgtcactattgcaatgaattatatgcgcaaaggacagaaagtaaatatcagagcagctactggagataaaattgcttcaagtcttcaattactgcaattccctaaacgctcagagtatccgcctgataccacttgggtaatgaatgatgttcttacttttgacggtactacttcttatgttccagtattgcaattatcttatattgaacatgctggaagtaaatactggattgttgctgataataatcttgaagaagctcaatcattccgtggcccatcacgagaatatcttgttaagcatttttcagctgaaatgaataatcttgtagaaaaactacaggttcctggaagccatatcggagcggacgtttccgatttcattaactactgccgtgggcagattgcaaagagaacaagaaatgaacaaagtaattcagattgaaattcctgaatataacgaccgtaaatctgctgcagcagctattgcaaaacttctggagcagtcagaagaaattgaacaagctgctgaagttatcgctgatgagcattgtttgacttttgatgtaggtgattatggaaacggccgtacttattatccagtaggctatgacgctcattggcttgtaggtcatcatggtgtagaagttgatgaaaatgaaaaacttgtagaaggcgtttggctttcttcctctgatatgtgctaaggtaaattatgactaaaactcgtgaagaaaaacgtaaagaaatcgaagaagttgcagttgaagtagctaaacttcttggtaaacttgaaactatggcgaatgaagcttcttttggcatggaagtttctggcggatatctgacctttaacgattggcagtcttctgattgctatggcgaaggtaactctgagacctttggggttaacgaggacggctctgtgtggtacactagcagctgttaatgggtaatatatggggagactgaaaagtttccccagaatcactggaggaacactatgaaaggtttagaccgtaattgctgctacattattgaccattatttctactatccgaacaaatacggaagccatgatagttgttgtcttgcagtactaatggacgctgtaatttgtaatggaaaacttgatactggagttagagaagcggctggagacattgtgcttcaacttcgtgaaagagagcatccatgggattctcttcctgaccaaatctttgacttactaggcggttggaactggaagaaatgctatccagccaatagaccagaagagcctattgaaaacttcatcagaatgtgtagaaagaaccgtttacaacagaagtcaagtgtgttatagtagttctacagtctaaagaggaaaatattatgttgctggttattggttctcgagcactacatcaccatggtctcattgattatagtgatgttaagaactctgattgggacttcattgcgtctccaggcgaatggcttcatttcaaaaaccgtatgaacggcacagaggttgaagttcaatctcctaatgtacgagctttcaaatgtatgcacaacggtcgtgagacttattttgaagcatacatttttgaatataacgacgagagttcatctgaactgcttgctcattacgcagtatttaatggatgctatgatgcgctttcacagatgtattgggcgactcctgagatgtgcttagcaattaaaatgtctcaccgattcaagaagaacactcgtttcttccaaaagactatgcatcatattcgtttcttgcgtaataagggaattgttttagacagtagactgaaaaagatttctgaactgcgccaaaaagagacattagcatattctcatcctaatctggatgtagataaagattctttcttcaaagatgatttttacatctatgaccacgattcaattcacgaagcagtggccttagctgggcgtcctgcttataccttctacatgaaagatggctctgaagtaatgacttcaaaagagaaatttgattctcttcctgaagaactcaagcttgcaggtgtatatgaagaaacttgcgtacttgctttagaacgtcatcaaattccaaacaatttcaacccagacactacgggttcatttatgtacgctttggaaaaagtttgtactagcattacatccggctggttccgtgagtatgcatgggaaaactaccataagatagttgcaatgcataagaaacttggaaagacagattatgtcaaacgctttaaacaaaactttgatatgattcgtcctttcaaatgataaagggccttcgggccctatgaggaaaataaaatgaattcaaatgaacttaaagctaaaattgctaagacagattctctttcaacaaaagtcagatatattttgactagaaatgaaaagctctgctgggtcataggattgtcaatatacgcaattattttgtttttgggctggtctgatatcacaaatcttccaaaagaagaaagagctgactctgctggagcaatggctgcgttcacatgttttggttggggaatgttggcaatcatcgtcatgttgattggcgaatttgtcaatgtgattgcccaaactttaattggcatgcgaagaaatagaatagtgtcaaagcttggcaaagctgagcgatttgaaggatttatcaacgactgccgtaaagcgaggaaatgatcatgggatatcagccaagaagcgaattaagagaacttgaagaaaaagcagacttttggcatatgatggtttgtcttgctgcatctgtaattacggtggcattgtgtttctttccttctattcttttacctgacccatatgctccaatttggttcgtcacatctatttttatagctataccttttatgatttggtcaaacaataaagctcccaagattgcaatttggtgggtgatgcgaccagaaaataaacgtttagctgaacagaatgctaaagttcttcgtaatagaataatccgagaatcagaagaattcattgcggaatgtcgaggtaaaaaatgaaatacaatcctaaaatgaatatcagacattttgaacgagaaattgccgatagattcaagtcgaaatatgaggatgacgtttgttgggcaattattatacttactgtcttcatatcaaatttcgtagtttggtggttcaatggatttgtagcagaaatgattatctctgtaccactaagcgcgttatgttcactattcgtggtaatagttttagcttcttttattaagtggtgttattgtaaaattcatgttaaattgtttactaaagccaaggccatttacgacgacaaacaaaatttagagaactttatctccagatgcaggattaaacgatgattaaaacattatttcgcggattcaaagatgctggttcatatgataattttggatgggctgtttgtacaataattatttgctttatgttcacaatgctttatgggtttggaacatattggggattgtacttctttagtcctttgtatggtgaacaattactttttgttggctggatggctggcattttaactccattctactggattggaaagtggttattttatcttgggcaggttcaacgtggaaccttcgaccaaaagaaagagtggaaactctttaaacgaaaatctaagtctaaagaagttccaccaggtgaagatgctttaaactttattcaaggtattagaggtacacgatgagttgtccagctacgatttttacttcgctgaatggcgaaattaacggttcagtacatcataattggggatggattccgccatccgattatgaggttgcaactaaagttttacgtatcgttgaaaatgttccaggagaactgcgcaacggacagttagctgctaaatgggataagctttatattccaccatttggtaatatgctaaaagaaaagtactgggacatgtacgatacgctgaagaacattcactatggtctgatggaccgtaaagattttaaactgtctgacttcttagaggaaaaggtatgagtattgcagtatttgtaaaatccgaatcagctgattcttatttgtactcttttaatgataatgagtcagttgatgatattcgtaatcgtcttgctacggacctggaaatgttcactccaattagtgattggatggttgaaggttcgtttgattctgacgaagatatgattgaagaagttgagtcaatcatgcaaagacttcgtgaaattagttggggtgaaatttgagtaagaaaattaaagaagtatctgcaggaattatcttctttaccgaagactacgaactattcatgggaagagtgactaattctggattaggcggtgggccatcacgctgggatattccaaagggtcatattgaagaaggtgaaacacctattgaagctgctattcgcgaatgtcgtgaagaaaccggctttgttgattacgaccagagtttactggttgacctaggtcgtcatgattatgctagcaataaagatatacatcttttccaacacatgcatccagtggaacactctcaattcagagattgtatttgcacggcatatcatacagatgaagacggaaatgaattcccggagattgatgcttttgctttgattcatccgcgcatgtggaatgtagtaatgggtccaagtcttttctcagttatgcagaaactttatccaaaggtcattcaagatgctctttgggaatgctaaataaatactcctatcaactgataggaggtcctcatggacatttttggcatgcttcgtatcgatgaaggatacgattctaaaatctataaagacaccgaaggtttttggacaatcggtatcggtcaccttttgacacgtgacccttctcttgatgttgctaaacgagaacttgataagcttgtggggcgtccatgtaatggtcaaatcacaaaagccgaagcagaagctatttttgctaaagacgtcgataaagcaactcgagggattctcggaaatgctgtattaaaaccagtatatgatgtacttgatggagttcgtcgcgctgcactcattaatatggttttccagatgggcgttgcaggtgtagctggtttcccagcatcaatgcgtctgcttaaatcaaaacaatgggaagcagctgcaaaagagcttgctaattccaagtggtatcgtcagacaccaaatcgtgctaaacgagtaattgaaacattccgagttggaacatggaaagcatatgaaaacctataatgaatttttaaatgaagcagctgaacaaaagcgagtccaaggtggttacatctggattgagaatatcaaacctggtgatgacactggtgtctggaaagtaactgcggatggtcccggcggtaagcgcgtaactatcaaggataatatcgctggatataaagcagcccgcactgtagcaaccggtcatatgcgcaaaattatggttgataacccaaccaataaatttgctgctaaagtcttccgtcgtgaaggcaataaattggttgacccatttagttaatcctcaatcaaaaagccaacctggacctctcctcatgaacgtcgtgtcctctgagtgaagtagcttctggtacctgtgaaaaggtcgagcccaagtgcggtaaagccagttacaatcagggtcctagcactcccgctagctgatggaaattcttgagccatggaaggccctcactaacggtaagtaactctatgaaaatgaaatctctatttgctccatatctatccctgatgcacgcattcaaaatccgtgctgatgattgtatagaaatcctcaaagaaagtcattacactcctatagatattctacgcgaatatgctacgctaaaaatcgatggcggacgccaatcaggtaaaactaaagctgttgctgaatttgcagcagattggttacatgatggtggaactgtttggattattagcactcatcaacgaaactccgaagaaacagctaaaagaataagagcttgttatgagaaagaactcattcatcaagcaaatccagaagaagccaaacgcatgataatcatggacactgtgcgaagtttcctaagcgacggtggctcaaaagcccgtggccgaacgcttaacagaatcttgtatattatagaagaaccaatgaaactccctgaaatggaaaaattctatgaagcccatttcaaaggtccgttttatgcatgtgttcatcaatcacacgttactggtgaagagatgattccattattctttgtgataggaatgcaatgatgaaagaaaattttaataagggccttcgggcccttgatatgaccattggtgaatatatccgctttttgcgttctactggaaaatgtaatgtagaatctttgattaatattctgcatatcaaattttcagatggggcagttcttgagccaaagctgtatcgatttttagatggaccttttaaaggctcattgttcctctgcacttcgccagatgtgggtctgatgaatgagcatccgtggtttgaagtagagtttatctctggcccatgcaaaggcatcaaaacttcaagcttaattacttacgaccgcaaggtcatttctttggagccaacatggcgcaaattgttatcaatatcccagaccacttggttgaatgtttctgtagctggttttcaaaccaaggcgaacaagatttaatggaagcccatgctaatggtgtgtggaatgaagaaactatgcaatgggaagatgctaaaacttatatcggtgttcaaggctacggtgtgaatgagcctattcgcattgtagaatatgataaagaaactgacgaggaaattccttatgtcgattgaacgtaaagactatgaattagaagatgaggtagatgaatcttcttctccgttcaattacaaatctgctgaagatgcaggttatggtaaaacgtggggtcttcagaaaatggttcctcctacgggtcaaatttttaaattaaggaaagctgaatgattgaagatatcaagggctataagccgcataccgatgataaaataggtaaagtgaatgctattaaagatgctgaagttcgtctcggcttgatttttaaagctcttgaagaagagcatgtaaaagtatacatggacttggatgttgacactataagcgacgaagaattcgatctagctcattctagaatcactcagattcgtaatgcaattgatcgtttgaaagaagcttctatgtgggcatgccgttcagtcttccagccagaagaaaagtattaatgtcaattcgtaacaaagtctccgagtctttctccgaagctatcaatgctatggaagaaaagatggagcagcttgtggatgagtctatgggtcttcatgaccctaagacttctgatgctttcaatgttgttcaggacaaaatctccaagctccgtcaacgcatcgcggacaccaagaagctgcgcagcaatgttctgcttcaagtgttctacgatgaccacaactactgactatttactttctccaagggctatgatactatagccctatcaacaaaggagattgaaaatgacaactaacccagaagtattcatccgccgaaacaagctacgtcgtcgctttgagactgaattcaagagtgtaaacgattctatacgtagtgcttgcgcatctgctggtattccagctttctttattaaatattctaatcacctcctggaccgtgctatccagcgagaaattgatgaagagtatgtgttcgctctgttccacaaagtacacaatcatgtaacagaaattcacgagttcttagaaatgccgatgcttccaattgacccatcggaaattgacccagaagtagagtacagacctcaacgtctggaaatcacagatggtactctatggcttggaatgactgtttctttaccaaacccagaacacccgttccgtggtcactccatgcaatgtcgcatggcattcgtaaatgataaacgcttgaaaggtaaaatcagcacaaagattatcaagttatagctttaatttgaggtaaacatgaaaaaagctctatgcgcggcgttactcctagtttcgtctctaggattcgcgtccgaacacaccttcagtaatgtccaactcgacaatttgcaatacgcatattcgtttggtgaacaatttcagaagaatgggaagtataaagaccatagtaagcgctatgacaatgatggacttggttacattatggctgcactagtctggcaggaaagttctgcaggcttacgtacaactggtaaacatgggcatcaagcttacgggatatttcaaaattatcttcctacacttagggaaagagttaaacaagccggatggtcaatgacagacgctgaaatcatccgcatggcaaagagccggaagcactccgccgcttgggcgtatattgagttaagttattggttagaccgtcataacggtgatatgagaaaagccatagcgtcatacaacgcaggaaacaagtggaaagccggtaacaagtacgcctctgatgtattagcaaaggcgaattacttgaaatctcgtaaaatgcttcattatacggtggaataatgaaaaaggtgtttgtacttcttgttgtatttgctctatctgggtgtaagatggattttgctactgagcaggatgattcactggcattagcaaagcaattctgcactaagactaatacggagtgtttgaacattttgtcatttgactttgacaaaacttatgctgaaggacaaactgattctggtagccgctttaaatggtctaccttggtggctcgtaaggctaaagacctggagtcgttgtgtgataatgcgcctgatatgaatgtttgcgaagaatatcgtgacacattattgagggtgtatatagcgggattatctaagtgaaaatagcagcatttctgctagctctaccattatcggtaaatgcctgggaaaaactcccaggctatcctgataatatctacgctattgatggtaagctagttgaaacaactggttcgtttaaaaagaatattgaagtttcttactatccgaaaaagaaagcttttggtgtatcattttacaatttctctaacaaagaagaccaagctattattcctggtggttcaattcattttcgaggttgcggagccaaatcctccggaatcatcaatggagtatcgatagatttttctgaaagagatttgaagtctttcaaaaagttaacatgtggcgaagaaatttatgcgcgagtttacgatgaatttgaaaactacgctacttatcaatttaaaagcatacctgagttgaggaaaagatgattgtaaattacattaaaggcgatattgttaagctatattctgaaggcaaagttattgctcatggttgtaactgtttccatactatgggtgctggtgtagcaggacaacttgcttcaaaatttccggttattttgtcaactgacaaagcagctacagattatgctgaccataaaaagcttggaacttttagcttagcgttagcactaaatggtggtgcttgctttaatctttacactcaatatgaaccaggtcctaatcttgattatggtgctttagttaatgctttccagaaaatggacaaattcttatctggttctttgttcaaaatggatgtttatattcctcgtattggtgctggaatcgctggaggcgattgggaaaaaattgaagcactaattaatatgtttactccaaatgttgatattattgtagttgattgggacggcgaataatggctcagctttattttaactatgcttcaatgaatgctggtaaatcagcatctctgcttacagcagctcataactataaagagcgtggaatgggaacactcattcttaagccagctattgacacgcgagattcagcaaatgaagttgtatctcgtgttggtctacatgctgaagcaaataccatcactgaagacatggacattcttgagtttttcaaatgggcgcagactcaaaaagatattcactgtgtgtttgttgacgaagctcaattcttgacccagtctcacgttcttcagttatgtcagattgttgacctctataacactccagtgatggcctatggacttcgtacagatttccgtggtaacctatttaagggctctgccgctcttctggcgactgcagataaactctgcgaactgaagggtgtttgccattgtggtcgtaaagcaacaatggttgctcgtgttgaccaagaaggaaatgctatcgtagaaggtgatactattgaattaggtggtgaagacaaatacgtctcactttgtcgaaaacattggtgtgaaatgactggtatttatgaatagtgtaaaaatcttcgaggctatctactgatgaaattagtcatttgctatcgatgtcttcacgtttatgaccatgataccgctcctcgtacaaagacaaagcgtcttcgcgtaaaagaagctgaatgtccaaaatgcaaatgcaaggtaacattaggatgactattgatgtattattttggttattcgcttttccagctgctgggtttatcatagcagctttacttggattcttaaagattttaattgaagggaaagtatcaccatgaaatattttaaagcaggattttactaccattgaggtactttaactcaagaggtagatatgtcaagaactattcgtcgtaaaggctggcacgtaacaacttcttctaaatggcacgaccagaagaacaacgaattcgcttatatcaaacgatataccgaatacgtcaaaactaagaaagataaagagcatcaacagaaatatgttgataagcaaattgcacaaaacatggaaagaccgttagagcttgcttctatgatgaaaaagcgccatcgtgattcattctggaagactctgcgctggatgcgctatgcttcaccgattcctcgtgtatttcacaagatggaaatcaaacactcgttgagaaacgatacggactataattgggacgaaaaggctgctcgtaagtatgagaaaggtctgtgccaaatgttgtgggactaaagttaaattggggagcatgctcccctttataaatactattactaactaatgaggtatgtatgaagcatttgaacgataagcaacttcgtaatcttggtgtatctcaactggaagaaattaagtgcgagattggccacgctatctcaagtctaaacgaagagtttcgccagaatggtgcacgcccagactatttgcgtaaacgccagctgcaaaaatacctcgataaagttaaggctgttcttcagcacaaacttaatacaggacaacgctgaggcttttatgactctacgtgcattggctgcgattttatttgcagccactttaatctcgcccgtatcggcagaagaagcaaactttgaacaatacgctgatggcgctatggcagtatatagcaagttcaaagaaccttctaaagaagaatctgaacgtttcttttctttcattaagcagaaatgggcagcttcaagttgtactacccagtgcactgaagaaggagttcatgctggtaagcaatatgtttctctaacgaaggttaaacttgaaaacgaaatttgaagatttcataacaaccggaaagaaacttccagaggatgagttcattggtcttttgatggcttctgcatcatacttccactcagctcattttgaaactaaaagctatgctcgtcataaagcatacaatttcttctttgatgcaatccctgagttaaccgacaagttcggagagcaatggcttggatggtccggtaaaaagtacaccccatctataccatcgcaacaggatttgcctactgacacgattgagatgctcgatagcatcacagcaaaagctgaaagcatctacgataagatgcctggagcaatcagaaacacaattgacgaaatcaatggtatagtgtttcaaaccaaatacttgctgtctttggaataatttgagccctgactttttggtcagggcttttgttgttttaaaggaaccgtttacatcctcttcaaaaggtgatactatgaccttacacaaacaagaggagaacatcatgaatcgtattactaaattatctgatttcgttccaggccgaatcatgtaccacgtgtacggtgtatctcgcaccgaaactgaagtatctttagataatgtagagaagtacatcattctgagtaagccatatcgtagtccaacttcagatattttaatggttgatatcatctgtgaatacactggcatcaacggtgaattgaagcggtcttaccgcactcaaatctgccctggtgataacgctgtatttgaaaatgctgaacgtaagcctcataacttgaatcgtctgtttggtgatgttgagtctgctttagaatttatgaaagaacttaaagcagataaattctcttctccggaagaccaggaatatgctgaccattggactccaatccgagttcttgaagaaagaatggcttggggctggggtgatatctatgatgacggtgaatttgatacggcaggctggtaatgagaacggtatttgtactgctttatctgtttgttcaatatcacaatccgctgtttacatacaacttggttaatggtataatggacctcgttcaaaggagtttgtaatggcaagtggatggggtccaagtgacgacggatttgcagctattgaagctacagtaagtgatggaattgaatgggctcgtttggagctcatcaaatctcaaaatcgcgagagtgaaaaatattgcgaagattgcgacggagaaattccggaagctagacgcaaagctcaaaaaggatgtaccaggtgtgtggcttgtcaaagctcacacgacactatcgttaaagcgtcttacaacagacgcggttcaaaagattctcaattgaggtgattatgaaacatacatttgaaagcggttcagttcacggtcctctggttcttgaagtacgtggaaatttttgcaaacttggacatgtaggtgatgaagatttgttcaaaatccattttcgtctggacaaagcacatctgattgaatgtaaccaatgtcctaatattgattacactgattatggtgatgattcatttacatttgaagcaaaagatggaagctacggttgtgtatctttttgcggtaaagcaaaccttcaaaacttcttaaaagctattcaggagatgcaataatggctaagtgcactttagattggaatgtcccaggattagatgctactatcaactataaagctgaatcagtttatggtggtcatgccgatattaaaacaatgctcttcgttaatgccgataaagatattctcacaattatttcccaaggcgaagaagttgagcttcttaaagaagaagctgagaaattgctttcatggttgcaggttacaatacctcatatgaccacttctaaaaactttaaataaactgaattgaaaggaaattataatgcaaatcaatactaactcttggcactacaaactcgttactatgaatggcgctgaaagcgctccacgttctctgtgtccatatttttggaaaggtgtatggcacacattccttctggcatttgctgtattcgctgtgtgcttcgctggttggggttctggtgttgatgtagctacatggttgtttgctaagtgtggtgtagttctgtcttctgctgcagcaattattcctgggttgattgttggttggcttattctggccgctatttttggtacaattttctgtattggttacggaatttatcgagtcgttcaaagacgaaaagaaaagaaagaagataaaaaatgggaagctatcagaaatggtacttacgttgaaccacaacctaatatcattattgctttcattaaagctcgcaaagagaagttctgcccaactttggaatttaaataatgcttaaacaagaccagaactatattatcaacggtgaatctgctaaatttaatgcaactgtggacaaaggctttactggcctgcgtccagtagccgaatttatttttgccgacggacgcaaaattacagtagttcatgacaaactcagcggaagttctacatcttccgaaatgatggaccgttcagttgcatatcgtaatggctcatggcgctttttataggaaaatattatgtttattcgtcaagtgaaagctaaaggcattgtaaagaaagaacttgaagttggacgctcaattactgttcaatcaggaacaacagaatttgatggtgaaattgattttattagccgttgccaaggagcaactcatattttccttaaaatcaataaaaatcaacgagctgttttaaaagtatattcaactcgtgtaatgattgaactcttcatttatgatgaagataaaattacatcatatggtgttactaatgtgtatgtaacttcaattcgtaataagtacctggtcgatttcactaatttcagaccaaaagacggccgatatacagaaacatatgaagcggaagcttctggttttaaaaatattccggtagttgttggtgatgtcttccaaaagggttctaaagaattcactgtaattgctatcactaaaaatggtggtacaatgttcctcgaatccgaaagcggcgacggtctgccagttaatctgaatgacacttcattgattgcggctttcggtggtcaattcacatggggtcaaccgactaaatgattgaaatagaagttgtaactactaagaaaaaacttagtatgtcattgctaaaacaaatgccaatggcttctatttccggaataaaatttgctatgatggacccttctcaaagggtccttggatatgttaatgcttttaagtggaataagattaacattcaagtggcaatcattaataccggaagtgattgggcattagttccactatatgaaactgtgttaaaagagcatgttcagcgggaacaacacccggatggccaagaatatcatacgcatgaagtgaaatactattattcttaccagaaagttggaaatattaatagaacttcaaagaaaagcgaagataaagaacacgttgaacaatgtgttaaaattaccaatgagctagtaaaatttgccaaaggacaacacatttatctatgaaaacagttatgaaaggctacttcggtagccatctttacggtacgtcaacaccagaaagcgacacggacttcaaagaaatcttcgttccacacccaaaagatattcttatgggtcgtgcaatgaaccatactaatatgaatactaacaacacttcaacaaagaattctcacgatgatgttgaccatgaactctattctctcaagtattggttggaactcgctcagtcaggagaaactgttgctcttgatatgcttcatactcctactaatctgattgttaaatctgacctgcctgatgtctggaaatttatccaagacaaccgctggcgtttctacaccaccgatatgaaagcttatcttggttatgtgcgtaagcaagcggctaagtatggtgttaaaggttctcgtttagctgaacttcgtaaagtgcttgaggtgttagagccttatccagaatggaaatatgaagatcgtccaaaggataaagctcacaatgttcgttggaaagttgctgatattgctcatctgctgccgacttcagagttcctcgaatggactgattttgttgaccacaaatctggtgttcagaagttctacaacgtgcttggccgtaagttccagacaacaatcactgttgccgaaatgaaatacagtctcactaaactgtggaacgaatatggcgaacgtgctcgtaaagcagaagctaacgaaggcgtagattggaaagctctgtctcatgctcttcgtggcggtcttcagctccaggaaatctacacaactggtgatttggtttatccgcttaaagatgctgagttcatcaagaaagttaaagccggtactattccattcaaagaagttcaagaatggttagaaaactgcgtagatgaagttgaacgtcaaagcatcatcgcttctaaaaacggtatgcctgataaagttgacatgacgttctgggacaagttcttggaagaagtttatctggctaaccacaactcttactacaggtgattatggttactttacttttggctcaactatggtggattatgcccgtctttattgtattggtttatctagccgtcgggtggctcatcacaaacgctctcgttaaacgagggttcatagagacaccttttaattacttgtttagtattatattatggctacctgtcggtgtcatacaagtcatctggcgtatcttaagttggttgttaatgcagccaaagctgtttgctgaacgtcagctagaaaaacattcaaaataacctccttcgggaggttttgttgtttttgaagaaagttttcaaaaagtgtttacagatgctttaagttttgatactatatctctatcaactaaacggtaacaaaaatcaaggataataaaatggctacttcaaaaactttctacgcagtaactgaattcgattttggcggtatgggccacaaacagcatatggcacctgctatcatcgaatacgttgaatacatggaaaaaattcttaaaactaaagaaaatgcaaaagctgctggaactttgattgaagctgtaactccggttaaaagcaaaatggttcagatgcctaacggtcgtaaagcaaaacttttcaacgttggcaatgaagtatgggcgcgttactcagacggttcagcaactccatacattgcttaaaaatattgtttacaagtgctatagcatatggtattatagcactatcaaaaccaaaggataacaaaatgaaaactttacaaatcgtagtaaacaacgttgcaaaagccgaagaagtagctcgtcagtacaatgttaaatttgaagctttgatggtcggggaagttttttctaaattagcaaacatctctggtactactgacgaactgattgacttcgttgatgagttcttcttggactctaaagttcgtccttactatatcaacgaaattttagcattagtttaaaaatattgtttacaacggtatgagatgatgatactattacctcataccaaacaaatagaaactcggagaacaaaatgaaaaccatcactatcaccaaaggtactaacttcggtaaagaaatctctggtaccttcgaacttctgggcgagtggttcccaaaagatttatcagaatctgacgctgctcagggtgatggtaaagtattcgtaaacatcgatggtaagaaacgcggagtatgggttttccacggtgattacaaaattgaaggtcaagaagtcaaagaagttctgaccgaatctgttgaagaaatgaaagcacgtatcgctaaacgcttcaacgttatgggattaatgactgctggtctggttaacgggaacattcgttcactgattatctcaggtgctgctggtatcggtaagactttctccttggataaagcattaactaaagcagatgctcgcggtgatattgaatacaaaatggttaacggtaagatttctggtatcggtctttactgccgtctttgggaatctcgccattcaaattctgttctgcttattgatgatgtggacgtattttctgatatggacattctgaatcttctgaaagctgctcttgattctggcgaaaaacgtaaagtttgctggtcaactgcttctgctttcctggaagaaaaagatattccaaacgaatttgaatttgaaggtactatcgtattcatcactaacgttgatattgacaaagaattagaacgtggtagcaaattagctccgcatctttctgctttggtatctcgttctgtttatctggacctcggtgttcacacaaatgaagaaatcatgtctcgtgttgaagatgttattatgacaaccgacatgttgcagaaccgcggattaaagcactaccaagtacttgacgttctggcatttatgcaaaacaacgttaatcgtcttcgtaatgtatctctccgcacagctctttatctggcagatttcgtcgctactgacgagaaaaactggactgaaattgctgaagtaactatgctgaaataatcaaccacggggcgaaagccccaattgaggaaaatattatggcttctttaatttccaatgatgtaaagcgagttttatttaaaagcggaatgtatattgttgatgttcctaaaggaaatacttcttcttggactatttcaaactggattaattatatcgacgaaaatggagaatgggtacaatgaaagtaatcagtgtaaaagaatcggatgtatatgtcgccagagtttcaccagacgaccgccgctcagaagtttatggttactatgactcttactttaaagctgaagagagtgtcgctggtaaatcctggtacggttcaaacggtacagttgaccgtcaacctgttactgcattgacactcacctttgaagatggaagcaaactttctttcttaaagaaagatgcttttgaaattcgtactgaaacagaagcagaacgagttgctcgtttagaaaaagtaaaacaatatgctttatctaaattgaaccctgaagaaaaacgtgcattaggcttaatctgaggaaattataatgagtaaattaatcacttatgaaattaaatttaagcgttttgtcaacggtatttgggacgaaaagttccgtgtagcaactgtaaaagccgagaatcaatatcaagctgtatggcatcttggcacttataatgatgaccagaacattgaagatgttattgtgatggttcaatcaaaagacggaaatccatcttattttgaagaaggttggacttacgaaactatttctggcgataaagtcttgatgacgaaattcaaagaccttggtccagaccgtcgcacaggttatgaaactatcatggacgaaaatggttgtcatcgttatactcgtcgtgaccaaggacgttgcacaggttcagaaaattgcaaccctaaaaatattcaacttggcgtcttctggatgcgcatggatattgatgacccatatgattttgttatggaacgcaaatattctgataatgggaagggcgttaaaagtaaagaacggattgagatgaaattatgaaccctgaagagattcgagcattattaaaagaaatgcttaaagagaacttaacaatagaagttcgcaatgattcattatttggaacgttagaggttgaagtgaaatttgacgatgaacttataacttcttcatccatttacagaagcgatgttgaaaatctactaaggaaagacttatggtaactccgattcttattgcaatagctatttaaatttatttacttggcggagttttctttgccagcactttcggctggtgccttggaatgccagcatcaagctgtcgcactactaaacagaaagtagttaaatgtttagcagaatggtctatggttctattttatccattctggattattttcatggtttgtgttttaattgcaggtaaataatgggctacggactagatgaattaaatgattggtatgatgactatgaagacgaggactacgaaaatgaagcatatggctgcgagcctcggcccatcaacttgcatggtgaccgaattgaagtcctcagacttctcagtgatgctcagcggaataacaaaatccgagaaatcgaagagcgtagtagtcaaagttctcaaaagcagaccacaacccggtatgatatcatggaaccaatctaccgaaataatgcattaatgaaagttggcacaacattggtatgtccaagttgtggttcaccattcaagaagaaatcataccagcaaaagttctgtcgtactaatggaaataagtgcaaggactatttctggaattgtcatccagaccgaataggacgaacagaggagtggaagcagtgaatttaaaagatttaatcattaagaattacaaacagcggctatcagatattcattgcgacttcattcgcagaatggttggtgcggttgagctttatgaaaaacaatatgacagaggatttgagctattagttaaatacccaactgtcatagatataaaagggcgaatggctgcaaagtctgaattcattcgcctaaaaactattgggcttattgaaatggaccgaatgcaaatccatgcgcagcgcctgtttgaaaaagaaaaagcaataaatgaagaggcttttgaaactcaaatgaaagccactgaggttagtacttccgtgtggttctctggtgaccctaatactccagcttatcactaaagttcgccccggcttcgctggggcatttttgtatcctcgtaatatgatttatcatcctttccaagaaagttcctctcaaccgttctggtgaatccgcattcaaccgtttacatccttgaaaagctagtatatgatagtctcgtaatcaaccaatggagaaacaaaatgttaactgaaatcatcgattcaatcttagatgaaaatcgtaaagcacatgctgcacgccgagcgaaagttgaagaacgcgctttggagttgaatgctggatgggcgaagacccgctacggtcgtgaaggatttgataaggtggttgctccaacctggggaattgatgatcgtccacatgctccgttcgatggttatctctgggaaaatgatttaggcgaagtggaagcatatcacgctggtagttatcttccatacgttacggaacttgattactttgacaaaccagagtacacaggagaccatggatggtggaaacttcgtttaactgcagcaatgtacgttgaacttaagctttacggatgccctatcgaagtccgtgaaccttacaaacgctgggaacttgaagatttcaccactgttatgatggttgaagtcagagctcataagaacattcttgtggctattcaagaagcttccaagaaattctttgatgaactgtatgaatcgttcaagaagaacaaaggtgaagcacctaccggtaagcaaacagtgaaaggtaaagtcgtttcagttaagtgctgggaagattattacgggatgcaagtcaaaatgactgtccgtcttgaaaacggtgcaacggtctacggctctctgccaaaagcagttccgatggattatcgtggagtcattgaattctctgcaacttttgaacatgctaaagacgatagcactcattcattctttaagcgtccaactaaggtggttatatgctgattctttctaactgggtcgataacacggccctttatcctcctgcttatatctacgctggaatggctaaaggtaaagctgaaaagcaagcagaagctgtatgtgaagagctttataagttcacttggggtgataagaaaaacgtccttggagaactcagagaaatttggcgtcatgctagcattctctgtaaattgaactatgacggttcagtaaagcgcgaagttattgaaaagacttttgataaacttcaagaagctttaattgaagcaaataacaaactggttgaaacttttaaaaagcatcaggatttgaacaagtggtataaagaccatcttcaagtttcaaatgctcaactaaaagaagcagtgtatacttacaagcaagcacaacttcgtatcattgaagcgagagagatactatggaaatcataggagctattctggtttacttagccatcggcgcagtatcaactggattctttaagcttgtagaagactggttcatcgacatcgatggtgatactgctgcattgattatcatgacttggccaatcgtttgggtgatttttatctttaaagtagcaacttggccactgttttggatttgcgcaatcatcttcgattaatgctttaaaatccgtgatgtataatggtttcacggattctcaatcaaatcttacgcctgacaatgaaggaatagaaatgaaattagtaaatgtgttgaccaacaacaatttcaatacttacatcaaagaacttattgctaatgctgaagcatctttcaacttcgtcccaggcgaaggattacgagctgaccgaattgaaaaacttggatgtattcgtcagtggatttcaaccattttaaacactgaatttggtaaaatgggaattgacgctcgcatcaactctacgcgaatagctgttggagatgctaacaaacccgacgcctggattgatgtactgcgcaccagtggaattctccgtcgtgttaaagcaaataaccgtcttcgtcattacttaatgcaagctcctgacgaatacaatgctctttattataacgctgatggtgataaaactaatgtgcacacgaataaaatgcataatcaaagtgctgttaatttcatcattaatcagttttcttttgagtttcctcgtctgttacgtttgggtgcagcttttctgactgaaaacgacaaagctaaaactaacttcatgctttcaactagtaaatggaccattccgacaatttcatttattgaagaaagtgatgatgtaatgactatcaccattcgtgctggccgtgaaaacggtgatatggaacgaatctctaagcagattatttcagctcttaaacgaatgaatattgtgcgtttccataatcttgttgttgaaacaccccgccaacatcaaattatggttaacttgaatatcaagaaaaacgaagattttgttgctccagaagagccaattatgactcctaacacggttaaagaaattgttgaaactcctgtggacgcaagcaaagttattaaagcgaaaattaacgaacttgaaaaagagttcaatgaacttgaaacgaaaaagcgtaatcttaatgacgaagtttcacgaatcagttctcgtactattcagttgaaacgccagatggaaacattgcgaatttcgttagaagttatttctgaacctaaggctggtgtatgaaaaagcaactgcatgaagatattgatttaagtcaagaaattcttgatgaccctgaaggaatggagcggcttctggccgctactcgctgggaagcgatgatggaaatggttgaacgccgtgaagctgcagctaaacaagttacgccttgcccaaaatgtaatagtgttcaagtacaattagttaattggcaaactcctcaacttcagatgaaatgccgaatctgtttccataaatttgtgaaggaattaaaatgacaacccgtatgaaatttctcgtagcagcgatttgcttttggtgtttctctattttcactgatgtgcgtcctgacttttcaaaagaccagctcattaaagcagaattagttcaactttattccggaacctcaagcggtaagtactctcatctggaattcatcgcggtatacgaagaccaaaatggtcgaagatttgaccgagaaatttcacctgcattttatagcatggcacgtgttggttcaacatacgatttagaaatacgaccagaactaatctattctgaatatcgtcaaggctggaatgctgcctggtcattgggttctttcttcctttacattgtgacttatgtttttgctttcgtattttctgtgataggatgtttacctaaatcggctattgattggatgaattcagatatttaagaggaaaatattatgtcactcattgatttaaaattagacaccaatacaattcgtcagctgttcccagaaggaactgaaatccgttctgctttacaacagtctgttattcagaacatcgtcaaagagatggtgcttaaagattctgataacaaaattcgtaaagcagtttcacaagaaattgagttacttggtgctcgtgttccttcagtaaaagctgctgttgaaactgaactcaaagcatttttcactaagcgcggttggaacaactatgactcaacatttgagttagatactgcaatgcggaaagaagctactgaagttgctcagaatattattcagaataaaattactaagtgtattgaagaagctgctaaaaaattagaaaaccgcattgaagaaactcttcaaatgactgaacaacgttgggaacgaatgattgtttctcatatcaataatcattttggtaatatgcttgataaagcaattgctgaacgtattgctgccgctttccctgaggtgaagaaatgaaaattaccggtgcactttggaaagaattctacaacgatgaagtcttctgggaaggctattatcatgacgatacactgattctgtttgatggcgtagaagttgaagattatgaagacccagctccagatacagtagttacaatcgagtctggttacgtctataaaaatgatgaagacagttttacagctcatgaccttcgtttagaaactttctttaagcgttggaaaaagaagcaaacaactcgcactattgtggtcacagtcaacaaagacgattttgacgaagtgttagaagtcatccgcaacattcctggtgttaaggcggtcaaatgaatccatttcaaagtagtgctatttctgaaactgaagagatgaaatctctgtttaaagagcttcgcgaaattgccgggcgtatttgtcttcaatacgctgaagaaaaaggtgaaaatcttaacatggaccatgtccatcgttctcttcacgcttcaattgattttgatgttataatgttcaaaacatatgcataccatcaattgaatagtcaacctaacacttctcttccaatgagtgaaaagattgctgttgcagctcacgagtcttataagagattaaaagaactatgagccgtaaagaatatatgattgaggctgaagacagcctcctccgaatgatggtagcttatcataaagaccatggtaaaatgccggattcttattcagttttgaagagtgctttaacccgtgctcattcatttgcgtttggctcaattaaccgtgaagttgcaaaacgtcttggtattaaatgggaccatcgcacacaaaatcatcccgactacgataaagtagtctcatcagttattgaggacatctctagtgacattcaaggttttcggttacgacagcaagcattttaaatgtgttccatgcattaactctaagcgtctgttagatgctaaacgtaaagattacgagttcatctctgtgacttcaggtaataatgaagatggtaccccaatcttcaatgaagaagttatctctgagcttctgacgcgtctgaatagaccatctcgcgttggtctaacaatgccccagatttttgatgaaaaaggttcgcctatcggtggatttactgaattgaaggaatatttgaaatgagtctgaactctgtattgattgacccaaagacagaagaagtaatttgctctgctgagcttgctcgtcttcgcgaatgcgaagctttactttgggaagtcgaacgttctcttccaagtggtttagaatcttgggttgatgatgaagttcttgaaactttacgaggtgaataatgatttctgaaatgaaagaaaaaattctgaaagaaatcatggaagaccatgatgggcattcagagtattacgactttgaagactctgattatcttgaagaagtagaccatgatgaatggactcagaatcacaagtatcaatatcgtcaagtagtttactacagcaagaaacatgatgttcacgtcgctgtaaatgaaactcgttctggttcgtatcatactgattggtactatatggagcctgatgtctcgttaatcgagaaacgcgagcgtaaagtaactaagactatcacagaatgggttacgctctaaaaccttggtatgcggctcgatgggaaactctcgagccagaggaagaagaacgctttcctgaagatgattataatgaacctaccaacaatgaattaatcgatatggagtttggatatgagtttcctgaataaagtttttcgtgttattgaagaagatgaagagctgctttctcaattccctgaatttgtaaagggtgcggaatttaaagttctgagcatcagtaaagtaggcgaatcaactggcatgacttctgttcaatttaagaacggcccttatgttcatgttaaaactgctactcatccagaaattagtggtcaagattcatggttctggtgcttctactctgatgaaattgatcatttagaagaacttgaagaactttcttctgaccaatacagctcttctgaagatatccctcgtaacctttttaacggaaaagatattactgcgcagctctataaaatggctggtcaagaaaattgtgattctgaagaatatgatttgatgcaagctgctgcagattatattcgttggcttgaatctcaattggagtttaactccaggaagttctaaactataaatagttcatctaatattgaggtgaactatgttattgaccagcaaactctacaaagaagaaaaacaaagactatttgatgcacagcatggtatctgtcctatttgtaaacgtgaattagacagcgatgttcaaagtaaccaccttgaccacgaccatgaattgaacgggccaaaagctggtaaagttcgtggtttactgtgtaatttgtgtaacgcagcagaaggtcaaatgaagcataagttcaaccgctctggtttgaaaggtcgtgaagtcgactacctcgagtggcttgagagtttgctgacctatctgaagaatgactatactaaaaacaacattcatcctaatttcattggcgataagtcaaaagaattcagtcgacttggtaaacccgagatgatagctgaaatgaatgcttacgggtttacctattctgaagatgattccaaaccaaagcttgttgcttcattcaaaaagcaacttcgtaagagtttaaaatgacaattgaatcagaaatccagggtttaatcaaccgcaccaacaaagacttactcaacgagaatgctaataaagattctcgtgtttttccaactcaacgagacctgatggcaggaattgtttcaaaacacattgctcgtcaggttatctctcctactgttctaaatgctcatgataaaggtcttattcattttcatgacttagactattctccagctcttccattcactaactgttgcttagtcgatttgaagggtatgctcagcaatggatttaaacttggtaatgctcaaattgagactccaaagtcaattggtgtagcaactgctattatggctcaaatcactgctcaagtagcttcacatcaatatggtggaacgacatttgctaatgttgatgttgtacttgctccttttgtagagaagactttctttaagcatttacacgatgcagaaagatacggcattgagcatgtcaatgactatgtatacgcgattgagaaaacagaaaaagacgtatacgacgcattccaagcttatgaatatgaagtcaatactctgttcagttcaaatggacaaactccattcgtgacaattacctttggtactggtacaagcgattatgaacgaatgattcaaaaagctattctcaaaaatagaatcaaaggtcttggacgagacggaatcactccgatttttcctaagctcgttatgtttgttgaagaaggaattaaccttcatcctactgatgtgaactatgacatcaaacaacttgcattggaatgtgcaagtaagcgaatgtatcctgacatcattagttcaaagaataaccgtctaatcactggttcttctgttccagtttctccaatgggatgtcgttcattccttggcgtatggaagaacaaagacggtgaagaaattcttgacggacgtaataatcttggcgtagtgacaattaaccttccacgagtagcactcgattgtatggttgatggtcgtccagatttgaccaagttcttccatattcttgatgaccgtttgaagatttgtaaagaagctcttttagctcgtattgaatcgcttcgtggtgtaacagcttcggtagctcctattctttaccaagaaggtgcttttggtgttcgtcttaagccaaacgatgagattctcgacatcttccgaaatggtcgttcttcaatttcgttagggtacatcggaatccatgaagttcaaactctattgggtgctgatatcggtaagcttcttctgaaatgcctgaacgattatcttgctgaatggactaaagagactggctttgcttttagtctttattcaactccagcagagaacttgtgctatcgcttctgtaagattgatgctgaagtccatggtgacattaaaggcgtcaccgataaagggtggtacactaacagcttccatgtttcagtagaagaaaagatttctccattcggtaaaattgaccgtgaatctattttccactttattgccaaaggtggtcatatcagttatgtagaacttcctgatatgaagaacaatctcaaaggccttgaagctgtatgggattatgctgttgagcatcttgattacttcggtgtgaacatgccagttgataagtgctttacatgcggttcaactcatgaaatgactccaacagaagatggattcgtctgtcatgaatgtggtgaatcagaccctaaaaagatgaacacaatcaggcgcacttgtggatatcttggtaatccgtctgaacgcggatttaatcttggtaagaacaaagaaataatgcacaggacgaaacactgtgaagtatgacagaatctatccttgtgattttgtgaatggccctggttgcagggtcgttcttttcgtcaccgggtgtttgcataaatgcgaaggatgttataataaatccacatggaatccacgtaatggaacagagttcaccggtgaaaccattgaagaaatcagagagcttttaagcaaagattacattcaaggaatcactcttacaggtggagaccctctttatccagacaacagagaaactatagaagcactacttaagtgcttacataatagtcaccctcacaaagatgtttggatgtggacgggctacaagttcgaagatatcaaggacttggaactgctaaattatgttgatgttattatcgatggtaaatatgaacagtctctaccaactaaaaagctttggagaggcagtgataatcaaaggctgtggattaacagcggaacttggaatgaggaacacaatgaacatcctgaataaactcgcattaaacgcaaacttcatcattcaaagttggggtgaagaattccctgctctgtacgttttcgctggtatcgtaactttctcctaaggaacaacatgaaatacatcaaatctttcttcaacgggactcgtactgctttatctaagcttctggcttatattgttattgcttacggaattattgttgctgtacctgcactcttggtattcggactggcagtgattatcgctccgaagactgatgataagcctaaactttctcctgaagaagtcactgctcgtattcgtcgaatgactgatgcgcttaaggatattggtttagatgataagcttgaggttacagtcaatggaaaactcacaactaagagctaaaatttatggaattccggaagacgtctatcgctgcgctggttgcgcagcagtcaaagaaatttttgacgaattcaaaattccatatgagttcatcgacgttatctacatggccggtgacgtccaatacaactacaaggcgattgaagaagccgctaaagcctcaggagttttcccaagcaagcgcgtcaattacccggtcgtcatcctcgatggtgtatattacccaaatctaagaacaataaaagaaagactcggtgaactaggttacgacctcgattcgctggattaactctaagacactttcttttgaagtccatataaacatatggctcacatcttcggggaccctagcggtccccatttttatttctaccaaccgtttacatccgttgcggaaggtgttactatactcttacaccaaccaaggagagtaacatgattacactgaaaaagaaagtaactgtcgagttaggagttttcattcgttctgaaagccgtggtcaagaacgtatgaacattgaaatcaacaacgttgaagttgttcttcgtggtcgttcgtgtatgacagaagtttcaattagtgctgctcgtcatcgcccaagttcaatcactaatgctatctatgctctgatttcagatattgaaaaagatgaagcggctgaactgactcgtgctatctacgaatacgtcaaaaactgctaattttgctataagggattcggaatagaatctcttatgtcaaacttagttaaaatgaggaaatcaatatgtcacaggctatcaaaaacgtactgaacgctttcgtattcccgaaggtggaagcaatgaaagttgatggtgagttcaaagacgttatcgtgactcctaagttgctggataagtgggaagttgaactgcacggtacgatgaaagaaaatgaccagaaaattggtaaagctcgtatccgtgaactggttgttgcttacattctgtccgaatttaatcttgatgctttcggtattccaactacaaagcgcaaagaaatctctgacagcactatccgtcgtatgaagaaccagcgtaagaaaggcttcgttgacctcaaaattgttaaggccgccaaatgaatgaaggtataagtgttatcatattgatatctcataaaatagacgtttggcatgctaaactgcacgctagattcgtctttggaaccaattgggaagatatcaataatgctgttgattatctcaaagcatgcgaaatgataaacaaaaatttccaagttagatatttcccagttcaagatagaagtgtggattgtcctttttatcatatgtgggaagaaggaatgacagaggaagaactgaaggagtacctcgatgaatgaaattgaaaatgacctggagctagccggatttcaaacaaagcgtacggaagacggccgcttaatgattgaaggtacttcaaagaacgatgttgatttcgttattgaagaagattttgacgcctggtgggtttatgaatacactgggaaagactatcactcagtagatgcattcggaagtatggatgaagctattgaatgtgctaaggaacttatcctatgaaatataatcaattcactatcacagtattgaactacggcgactgggttattcgccgtgatggtaccgtttatttctctgatgaagagactggtgcttactgggaatctgatattgctattttccgcgattacactccagatattctttatcgcgaattctgtgaagaaacttgcgaagaccttgaacctatgcactacaatacgtttaagactttaattgaagatacttttaaggtatttgacttatgagccgaattactttagataatattgaaatcgcgtcattccgtgttactgggttgggtgaatttttcgtagataagtggatgggaattacattctcagactccaatgaacctggtcctagtcttgaatatgtctggcgaggccatgtatctaagctgaatgaaaatggctacatcgaattatggaaatcatggctcagattctgtaatgaaaatgcttttgagcctgaactcgattttgttactttccgcaaactcatgattaagtgcttttcgctttacgaactccttaaatagatgcttaaaatactcttcctccaaacgtgttataatattcttattaaatgaagcggaagaggtaatatggctaactatgtaaataataaggagttgctgaaagccatcactgagtggaaacagcaatgccgcgaagctggtaaacccgttcgtcagaatgatactatcggcagagcaattatgttgatatctgagggtctgagtaagcgttttaacttttcggggtacacccgctcttggaaagatgaaatgatttcagacggtgtagaagcttctatcaaaggtctacacaacttcgatgaaacaaagtacgacaacccgcatgcgtatataacccgtgcttgctttaacgcattcgtccaacgtatcaagaaagaacgtaaggaagttgctaaaaagtatagctattttgttcacaacgtctatgacgctcgtgacgatgatatggttgcgttagtagatgaaacttttattcaagacatctatgataaaatgacgcattacgaaacctccacctacaaacagccagggtctgacaaaaagagcgatgttgtagatgaaggcccgaacttggattttttatatgaggctgacgattaacctcgcaggtttcctggaagaagtgcccgattacgatgctatcccttatttgcttaaaatgtatatgagggaggtattggatttggacattcacatcgaccccaagaacccacatgacgctgaattcacttctgataatgctgagataactcacagttataatctaggagaaaatgattttagcataacaattgattacaaaagtaagtaggtcaaatgaacgaacgtaatattgacagcgtagaacaaatcgacgataacgaagaagaacgtattaagcgtttgattgaagaagaaagccagagacgtgcaaatgctatggcgactaaaatcttcaaaaagaatcgtcgtgaaattaagcgactgaatgaccatgcagctggcgcagtcctcgaaaataatttcgaagcatataagtacgctctctgtaaactgcgtgacatttacaaacagccttataatgacgaaatcatccgtgttaactggcagactacacgccaacaagtatgggaaatcatcaatgctggtacaaaaaccgtttaagcgtttaaaagttaatgcaggttttactctgtcagtttctaatggagtcatggcagtaaaactatccgaaactcattatcgtgttcttggaagcacaggcccggcagtaaaagcttctcctaaagaagttgtgtgggttgatactctccaagttaaaccatggtggaaactttaatgttgcctcgcagcatgcctcaagattggccttctggcgattatatgtgcacatgcagagattgcggtatcaattatatcggtccaaagcgttctatattttgtaatatctgcaattcatctgaaagaccagaaccaaaaattgattatgaagctattcataattcaaaaattgaaatgtggaaaaaattcaatgaagctaagaaattagccgaggaattgggttatgttctcgttaagaaaatttgatgcagaagatgtcgatgtctttgatgaattcgacggattttaattaagggccttcgggccctttctgctttctggagtatggaatataattttattatgacatacataacttactttacaatatactccggagataaacttcctccgttttacattggttctacgtctttgaacaaacatcttaaaggctatcatggaactgtcctttcaaagaaatattcaaaaatctataagcaagagcttaaagaccatccagaactatttgacagctgtatcatcggagaattcaaaaccagagatgaagcaacagagtgtgagttgtactatcaaaaacttcatgatgtagttaaaagcgataagtttttcaatatgtcgctagcttcaattggcggttgccatgggatggacacatcaggagagaatcatcctttgtatggttctaataatggcgcaggaaatattcactctcacaacccaattactggtgaaagcgcatttttgccttatataccagaaggttttgttaaaggaagagctaattataaagcatcaactcataataaaggaaaacgttggtataataatggtacgaaacaaatgatggctcatgaacagcccggtccagaatggaagcctgggaaaataaaagagctagtatccaaagctgctaaattaggttggaaaagacaccatgaaaattctaaacacgggtgattggcacctcggaattaaaggtgatgacccatggcttcaagaaattcaacgcgacggaattcgtcaaaagattgaatattcaaagaagcacggaatcaccatgtggattcaatatggcgatatttttgatgttcgcaaagctattacgcataagactatggagtttgctagagaaatagctgatatgcttgcggaagcaggaattacaatgcatactgtagtgggtaaccatgatcttcactacaaaaataaaatgcatcctaacgctatcacagaattgcttaataagtatgaccacatcgtcgtgcatgacaaaccagagactgttgattttgacggatgcttaattgacctaattccatggctttgcgatgaaaacgtagcttctattatgaagcatgttaaagaatcatctgcagagtattgtattgggcactgggagcttaatggcttctattactacaaaggtttaaaatctcatggtctcgagccagatttccttaagtcatataagcaagtgtggtcagggcatttccatactatatcctctgctgccaatgttaagtatatcggcactccctggacccttacagcaggtgacgagaacgaccctcgcggattctggattttcgataccgcaacggaaagtatggattttgtgccaaacgaaaccacctggcatgtaagacttcaatatccattcactggtaagattgattacaacgactacaaaaatctttcagtccgagtaattgtcactgatgtcgataaagatatcactaagtttgaaaccgaacttgaaaaagtagttcatgaactacgcatggtttctaagattgacaattcagttgaatctgacgatgaagaagacattgaagttaaaagcttattagatttgatgtcagaatatattgatgcattggaagacttatctccaactgataacgctgcattgaaaaaatttgcacaagctctttatgttgaggctcagaatcaatgaagattttcaaattgaaccgagtcaagtatcagaatattatgtcagtgggcggacagcccattgatattcaacttgataaggtccacaaaacattaatcactggtaagaatggtgccggtaaaagtacaatgcttgaagcaattacattcgcattgtttggcaaaccattccgtgatttcaagaaaggccaattaatcaattccacaaacaagaaaggattgctgtgtgaattgtggatggaatatgatggtcattcgtattacatcaaacgtgggcagaaaccaaatgtctttgaaattgaacgcgatggtgctaagcttgatgaagcggcttcagttaaagacttccaaagttatttcgaagaactcattggaatgtcgtacacgagtttcaaacaagtcgtggtactcggaacagcaggctacactccgtttatgggtcttagtacacccgctcggagaaagttagtagaagacctgctcgaagtttcaatcattgctgaaatggataaactgaataagtctttggttcgagaactgaattctcaagttcaagttcttgatgcaaagaaagacggaattcagcaacaaatcaaaatctatgaagaaaacatagagaagcaaaagaaactttctggtgaaaacgttgctcgctggcagagtatgtacgaagagtctatggctgatgctcgtaacattcgttcaactatcgacgagctgaacaagaacttggctaacatcgtaattggcgaagaagataatgtgtctgaaggaattcagaaaactcagatggctgggatgactattctgaaccgcatcgagtcatacacaaaagttctgtcgttatatgataaaggcggtcattgtccaacatgtttgcaggatttgcactccagtgacactctaatcggccagattaactcgaaagttgatgaatgtaatatcaaacatgctgagttaaaaacgcatctagagaatcttcaagcatcccagatggaatatgaagcggttaaacgccgagccagagacatccgaggacaggtagcagccaaaactgaagagttgaaagcagctgttgagcgtattcgcaagattaaagcagctattgataaagcagctgaagagttcattgattattcagatgaaatcaaaacgcttaatgaagaattgaataaaatagttgataccaaatccaattcagtcatggaaaaatatcttcgtggtattcttacggagatgttcaaggattctggtattaaaggcttaataattaagaagtacattccgttgttcaataagcaaattaattcttatttgaaagtaatggatgctgattatgtctttactttgaacgaagagttcaatgaaactatcaaatctcgcggacgcgaagaatttagttacaactcttttagtcagggtgaaaaggcacgtattgatattgcgctgttattcacttggcgtgatatagctgaattagtatctggtgttaagattaactgtttgttcttagacgaagtattcgattctgctacggacgttgacggtgtaaaatctatcacacaaatactcaacaagatgcaagattcaaatatcttcatcatcagccatcgtgaccatgaccctcaagcatacggtcaacatcttcaaatgaagaaagttggtcgctttacggtactggaatgaaacaatacgcaaccgggaacgagttactaacgttccctgaacttaaaagatatgttctcatcaataatttttctggtgaagagcatgtcgttaccgaacagcatttaaaagatgctttcggtaaacagtatgataaaatatcttccaacaggcatcctgcttggacagtttctgaattttttgaatgagaaaataatatgctgaatatcgttactgatgttaaagaaatccaacctaaaaacgtacgtactgactccaatcctaacaatcagaataaaatccgtcgagcatgggttctgatgctgcctgaagaaattaaagaagctattaaacgcaaactgccagattctgaagttcgtttcgcttattactcttctattgataattcaatctccgaaaagtggattgaattaatgcgtaagcattatgaacgttcaattaaagctggcgctaaagttattctcgataaggtcggtggtgaacgtctggaagacgaattctgtactaacgctgatgaacagctgttggtagctgctgaaatcgttgctcaagaagtttatgatagcttcgctccatttgttgtaaaatctgaatcatctgaaactgaaattgaattgaactaaggaaaaacatgaaactgtctaaagaaactctgaatattctgaaaaacttctctaccatcaactctggtattatgctgaaacctggtaagttcatcatgacgcgtgcagttaatggtacaacttatgctgaagcaactatcgctgatgaaattgattttgaagttgcgatttatgaactgaacggcttccttggtattctgtctctggttaatgaagatgcagaaatttctctggctgatgacggtaacatcaaaattgctgatgctcgttcaacaattttctggccggcagctgacccaagcactatcgtattcccaagcaaaccaattccattcccggttgcttctgttatcgttgacttcaaatctgaagacttgcaacagctgatgcgagtatctcgtggtctgcagattgacacaatcaccatcactaataaagatggtaagattgttctgaatggtttcaataaggtagaagattctgctctggttcgtaccaaatattctctgactctcggcgattatgatggcacaaataacttcaacttcgttatcaacatgggtaacatgaagatgcagcctgccgattataaactgctgctctgggcacaaggtaagaaaactgctgctaagttcgaaggtgaacatgcaagttatgtagtagcaatggaagcagatagtactcacgatttctaattgtgataggatggtcttcggaccatccactgatttgattaattcaatatgaggaaattatgttaagcattaacgaaaaagaacacatcttcgaacagaaatatcgtccacaatcaatttcggaatgtattcttccggaatttgaccgccaagtattcgatgctatcatcaagaaaggcaccatccctcatatgattctggtatctgcatctccaggtacaggcaaaactactttagcaaaagcactttgtaacgacgtcggtgttgaaatgatgttcgttaatggttcagattgtaagattgatttcgtacgtggaccgctgacaaactttgcaacagctgcctcattatctggtaagcagaaagttattgtgattgacgaatttgatcgttcaggtcttgctgaatctcaacgtcacttacgttctttcatggaagcttattcaagcaactgtacaatcatcatcaccgctaacaacattgacggtattattgaaccacttcaatctcgttgccgtgttatcaaattcggtcaagcaactgatgacgataaacgcaacatgatgaaagaaatgattcgtcgttgtgtagaaatctgtaaaaatgaaaatatcaaagttgaagaccttaaagtcattgctgctctggtcaacaagaacttcccagattttcgtaagacgattggtgatttggaccattattcttccaaaggcgttattgattctggaattttggatttggtgacgaaaacttctggagatatcagtgatgttattgatgcactgaaatcaaaagatgttaaacaacttcgtgcattagctcctaagtatgcggtcaattattcttggtttatcgagaaacttgctaacgagctttacacgaaagttgataaagcaagtatcatcaggatgtatgagattgtcggtgagaacaatcaatatcatggtgtagcagcttcaactgaactgcacataacttatatgttcatgcaacttgttgtagagatgcaattcaaatgagtttattcgaagatgacgttcagctgaacgaacaccagattgcttggtatagtaaagatgaggcggagattaaacgtctctctgatactttcaaagaaacagcagaaaatgaattcttcgcaataatcggtgcaattaacgagaagaaagatatctcaatcggaactcgtgattattcgaagttcatggtagaaaatgctctatctcaatttccagaatgtatgccatcagtttatgtgatgaatttagttggttctggtttgtcagatgaagctcacttcaattatctgaaagcggctgttcctcgtggacgtcgttttggtaagtgggctaagttaaacgagagcgcccaggagacactcattctgaaagtattgatgaatcattatacaatcaatatcaatgacgctgagcgttatagagtgactctagccaacaaaaataaactgtttgagacattaaaacgtcttaaaggtacagtgactgatgagctggtcaaaagcattaccaaaaacgtgaaagaacaaaagcaacttaaaaaattagcattggaatggtaaaatgattgaaattactctgaaacaacctgaagattttctgaaagtgaaagaaaccctaactcgtatgggtattgctaataacaaagataaggtactatatcaaagttgccacattcttcagaaacagggcaagtactacatcgttcacttcaaagaaatgttgaagcttgatggtcgtcctgttactatcgattctgaagactacatccgtcgagattcaattgcccaactgttacaaggatggggcttacttgatatcgtgactccggatgttcatcttgctgaaatgcagaataacttccgtgttatcacattccagcagaaatctgaatggactctcaaatcaaaatacacgataggtgcataaatgacagaccaagagtttcttgataaacttaaaaacatcaagattaaagctcctgattggtttagtcttccaattgatgagcaaattcagtatcaagttaaagaaacattagaaaagtttcctgatagaaaagttatgttatgctttacttatgataaaaacaggcatccacgaatccaaaaacaagttatcgaggtttagatggttgaaggtactaaagaagaacaaattgaacgtcaaaaagaacatcttcgttctgctatgactccagacggaaaacgagtatatcctgatggttatgctttcatggcatactggaaagatgaagaaggtgtagttcaatacgaacctgcgcaaatttaataagggccttcgggccctttctgctatcagcggaacggagtataatagacataccaaagaccaatcactcggtctataggaaaaactaaggaaactcatggcacaagaattttatatctctattgaaaccgcaggtaatgacatcattgaacgttatattgactccaatggtgtagaacgtcaacgacgagttgaatattctccaactatgttttctcattctcaacaaggtgtgaagacaaagttctttgatatctatgggaaaccatgcgtcaagaacacattcccaaccatgaaagatgctcgtgattggattcgtcgtatggaagatatcggtcttgaagccatgggtatggatgacttcaaactcgcttatatctctgacacttatggttctgaaattgtctatgacaagaaattcattcgtgttgctaactgtgacatcgaagttacaggtgataaattcccagacccaatgaaagctatgtacgaaatcgatgcaatcactcattatgattcaatcgatgataagttctacgttttcgatttgttagattctctgtatggctcagtttcagaatgggacgcgaagttagctgcacgaagtgataaagaaggtggagacgaagttccacaacatattctcgaccgtgtagtgtacatgccattctattcagagaaagaacttcttctggaatacatcaatctctgggaacaaaagcgtccagcaattttcacaggctggaacattgaaggcttcgatattccatacatcatgaaccgtgttaagcatgtattgggtgaacgttcaatgaaacgattctctccaatcaatcgagtgaattcaaaactcattcagaacatgtacggtgaaaaagaagtattcagcattgacggtgtaacaattctggattacatggatttgtataagaagtactcgttcacgaaccaaccaacttataacttggattacatcgcacagtatgaaactaaacgtggtaagttgccgtacgatggaccaattaacaaacttcgtgaaacaaatcaccaacgatacattagctataacattatggacgttgagtccgtaggtggtattgaccgagttcgtggattcattgacctggcacttagtatgtcttattatgccaagatgccgtttggcggtgtaatgtctccgattaaaacttgggacgcaattatctttaactccctgaaagaacagaacaaagttgttcctcaaggtaagcgtcatatcaagcaaagttatccaggtgcatatgtatttgaaccattagcatgtgctcgtaagtacatcatgagtttcgacttaacatctctgtatccgagtatcattcgtcaggtgaatatttctccggaaacaattgttggtcaattcaaactttatgatatcgaagcttatatcaataagactgcaccacgaccaagcgacgaatattcatgttcaccgaacggttggatgtatcgtaaagatattgaaggtgtcatcccagtagaaatcgctaaggtattcttccagcgtaaagattggaagaaaaagatgttcgcagaagaacgtaacgcagaagaaattaagaaagttctggcagctggcgtattcggtgacattgatactccagatgaaactcgttacactcagtacactgacgaacagaaagcgtctctgaataagtacacgaagttggtgttggaaactatgctggctcgatgtgaagctgctgctattctagcaaacacaaaccagttgaaccgtaagattcttatcaacagtctttatggtgctttgggtaacatctacttccgttattatgaccttcgtaacgcatctgcgattacactgtttggtcaagtaggtattcgttggattgctcgtaaagttaacgagtatctgaataaggtgtgtggaactgaaggatttgatttcatcgcagcaggtgatactgactcaatctacgtttcagttgacaaggttattgaaaaagtaggtcttgaacgtttcaaaacgactgacgaagtggttgaattcatgaaccaattcggtaagaagaaaatggaaccgatgattgatactgcttatcgtgaactgtgcgagtatttcaataaccgtgaacatcttatgcacatggaccgagaagctatttcttgtccgccgcttggttcaaaaggttgtggtggattctggaaagctaagaaacgttatgcactgaacgtttacgacatggaagataagcgttatgctgaaccacacttgaagattatgggcatggaaactcagcaatcttctactccaaaagcggttcagaaagcactggaagaaagtattcgtcgtatggttcaagaaggcgaagaatcactgcaagaatactacaaacagtttgagaaggaatatcgtcagctggactacaaagttattgcagaagttaaaacttgtaatgacattggtaaatatgacgataatggtttccctggtctgaaatgcccgtatcacgttcgtggtgcactgacttataatcgtgcaacggcaggattctctgtcactccgattctcgagggtaacaaggtgatggttcttccacttcgtcagggtaacccattcggtgacaagtgtatcgcctggccatcaggtactgaacttccacaggaaattcgtcaagatgttctggcttggttggactatacgactctgttccaaaagtctttcgttaagcctcttgctggtatgtcagaagcttctggattggactatgaagaaaaagcatctttagacaatatgtttgatttctaaagcattgtacatcaccacatggatgtggtataattctcctatacacaaaggagaataaaatgatttactcaatcacagacgatagctacattccagtactgaagttcaatctcaaaagcactttttacttcctgagtgctggtggtgctgataagattttctttgacgatggtattgaaatcaccgaaaagaatctgcgagctaaacttaaagagacttctatcgttaacatctatcgtgaagatgaaagtgattggacttataaacttgtaactcacagatgaggatattgaaatgaaatttttagcagtagctgctgctatgttactggcaggttgtgcttatcaaggagacactgttcatgctagtactgtagggcaagttaagtatgtaggcggcactggtctggtgtatgctcgttcaactccacaggtcaagcagtcttctattcgtgaaggcgaagaatatcttgctcaacaaagagctaacgatcctatcgctcgtgaccaagcgcgcgttatgaaaaatcagcgagaacttgacgctacttatgaaaagcgagtagctgctcgtaaatgtcagtttgtcattgaagcacatggtgctgctttatatcaaacaatgtataataatcctacccgcaaaaatatcaacgcatttgaaaacttcaggtcttctggccaatatgaagcatttaaacgttgtatgaagaaaaactacgaagaggcaaaatgattgtaactccactgactaacgaagatattcgtgatgaactgtgccatgctctgttcaacgagatgtttgtaattgacaaaactggcgcaaagaccattgagttaattggtccatcttttgtagtaaccgaagattcaattttcggaacagttaaccaagaatatgttgaacgtgaacttgcgtggtacaaatccaagtctctgttcgtgaaagatattccgggtggtactccagcaatttgggaacaagtttcatcttcaaaaggcgaaattaactcaaactatggctgggcaatctggtctgctgaaaactataatcaattctcattctgcgcaactgagctgattgaaaaaccagattctcgtcgtgcaattatgatttacactcgtccaagtatgcaagttgattttgaacgtgatggtatgagtgatttcatgtgcactaacacagttcaatatcttattcgtgatggtcgtgtaaacgctgtcgttaatatgcgaagcaatgatgttgtatttggtttccgcaatgattatgcttggcagaaatatgtgttagaatcattagtagaaacagttaatgcaggttctggtgaaaaatatgttccaggcgacattatttggaacgctgggtctctgcacgtgtatgagcgtcatttctatctggttgaccattatcgtcaaaccggccggattgatgttaagaaatctgactacaaaggcaaatggaaatgattcaatttgtaattccgagttacaatcgtgtcggggcagttactgccctggatatgttccctactggttatgtacctcatttagtagttcgtgagtctcagaaagatgattatatcgcctactatggtgataaagcacaaattattcctattccagatgatgtaaatggcattgctggtactcgtcgtttgattactgaaatgtatcaaggccaacgaatttggatgctggacgacgacacgacaattcatactactgagattcgtgctaaagacgaccgtcgtattcttcatgatgttggaatgacatgggacgaattcaataaactcacacagtatgttgaagcagctatggactgtggattctatcacggccatgctcgtttgcctattttcaagattgattctaagtggggtcatttccgtgagaactcttatggattcactaacactttttacgatttaagcaaactttctgctgatgacattggatatggtatagtagacctgtccgaagatacatacgcattccttaaactcattaatatgggttatcctcatctggcgattttcaaatatctcgtcaaatctggcaaaggacaagctcctggcggcgtatcatctatgcgtaatgcggctaaacaaaatcgcgcattagaaaaaattcatgctgacttcccaactcaagctcgttggaaatcagaaggtgacccaaccaaaactatgtttggcactgacgagcctctgaaagtacttcgtatgtgcgtagccaagaaacaaaagtcagatgctttcaaaaaattcagtgagattgagcctactttatgaaaattgctatcctgaacttaggtaacaacatccaggggtttaaaacaacccctgcttctgagacaatttatctgtccgaatgcttaaaagatatggggcttgatgttgacctcatttcaatgaaaaatactcaatatggcatcgcatttgatgatgtcccagacccgaatgtatatgaccgagttctggtagttaatgcttctctgaacttctacggtggtgaagagaacaagatgaataaagcggcttatatgttcttgaacaaatataagtcaaagatttattatctgttcactgatattcgtcttccgtgggaacaagcgtggcgccgaatgtcgaagaaaaaatggtccagcaaatacactgaagagcagttcattgttcgctctccaattcgtgtagtttctcagggtcgtgaccttgaacaagctaaacgaattcactctgaccgtttagttggtgtctctaaggacagaatggaatttgtacacttcgcattggaccgtcataagatgtatcacagcgtcttcaagattgctgctgatggcatcaaaatgcgtgacctgatttatggtggaacattccgttcaggtaatcgcgaagctaagatggttgaatatctgtttgacactggcctggatgttgagttctttggttcagtaaaagcagaccaattcaagaatccagaattcccttggactactcctccagtatttcctgggaaggtagattctcgtgaaatggttcaacgtaactcaaccgcgtatgctactatcgtactcggtgataagacttacgataataaccaaatcactcctcgtgtatgggaagctctggcatctactgcagtggcattcttcgatagcacatttgaccctgacatgaatatcatggaaggtaatgagttcttctatgtgagcaatcgtcaagagcttgttgacaaaattaataaaatcaaaaacgacgaggactttagaattgaaactctcgaatatcagcataaaattcttcaaaaatatcttgatgaaaaaccaatttggcaagctgaattcaagaaagcaattgaaatctaaagaatacaccaccgactctgtcggtggtcattgtaatgcttgttgttacacaccttgtcaaaatgattcaccgcattgcaatccgctttaaaccgcagttgatataattactctatcttaaacctgtgagaaaaatattatggagacttatggaaaataattaatgtctgatttaaaatctcgtctgattaaagcatccacttctaaaatgaccgcatctctggataaatccaaattcttcaatgaaaaggatgtagttcgtactaagattccgatgcttaatatcgcgatttcaggtgcattagatggtggcatgcaatcaggtttaacaatctttgcgggtccgtcaaagcacttcaagtcaaatatgagtctgactatggtttccgcttatatgacaaaatatccggatgctatttgtctgttctacgactcagaattcggtatcactccagcatatcttcgtgcaatgggtgttgaccctggccgtgtagtacacactcctgtacaatctgttgaacagcttaagattgacatggtaaatcagctggaagaaattgaacgcggtgagaaagttatcgtattcatcgactccatcggtaacctggcgtctaagaaagaaacagaagatgctctgaacgaaaaatcagttgcggatatgactcgtgcgaaatcactgaagtctctgttccgtattgttacaccttacttctctatcaaaaacattccatgcgttgcggttaaccacacaatcgaaacaattgagatgttcagtaagactgtaatgactggtggtactggcccaatgtactcagcagatactgtgttcatcatcggtaaacgtcaaattaaagatggtacagaccttcaaggttatcagtttgttctgaacgctgagaaatctcgtactgtcaaagagaagagtaagttcttcatcgatgttaaattcgatggtggtattgacccttactctggcctgttagatatggcgttggaacttggttttgtagttaaacctaaaaatggttggtacgctcgtgaatatctggacgtagacaccggtgaaatggttcgcgaagagaaatcatggcgtgcaaaagatacttcaagcaccgcattctggggtcctctgtttaaacatcagccattccgtgatgcaattaagaaccgctatcagttgggtgctattgaaaccaacgcagtggtagatgaagaagttgatgctctgattaattcgaagaccgaagaattccatgctccggaaggcgaagtaagagcaactccagcttcaatcgaagatgaactggaaaattacgaagatgaagaatgatttcgaggatttagacctcgatttgactgatgttgaagttcaagatgaaaccccctcttcggagggggaatttgaaagaactgagcggatgtttaaaaagagtctagaaatagtccaaaaggctatggagaatgtcgttcaggaaatcctgataaccctagaggatggcgaggaacatatcgtatatgttacctcattacacttggacgaaagcggccaggtgtcactagagttctctacgttggacgaatcacgaaaagccgaccttgcaccacatgttgaaaaatgtattaaaatacaaattcaacaggctcacgccgaaattatgagaaagaaaaaacgtttcaaactattttaatgaggttatcgtggtagaaacaatcttatctcatttgctgtataatcaggccttcttcgcgaaggtttggccttatatgggagatgagtattttgaacatggcccagccaaaaatgttttcaaactgattcatcagcacgttcttaaatatcaagctgttccaagtaaaactgcattagcggtagctttggataatagtcagttagttgaaactgaagtacagggcgcaagtgagttaattaataagcttcaagatactccagaagatttaaactggctcgtagctgaaactgaacgttttgttcaagaatctgcgatgtacaatgcaacatcaaagattattgaaattcagactaacgcccaacttccaccagaaaaacgaaacaaaaaacttcctgatgtaggtgcaattccggacatcatgcgagctgctctgtcaatttcatttgatagttacattggtcatgattggatggaagaccatgaagctcgttggttagcttatcagaataaagctcgtaaggttgcattcaaactcaatattctgaaccgaatcacaaaaggcggtgcagagactggtactttgaacgtattactcgccggtgtaaacgttggtaagtcattaggtctgtgttctcttgctgctgactatcttcagatgggtaagaacgttctgtatatctccatggaaatggcagaagaagtttgtgcaaaacgtattgatgctaacttacttgatgtatcgttggacgatattgatgatggtcatatttcatatgctgaatacaaaggtaagatggaaaaatggcgctcaaagaatactcttggtcgtctgattatcaagcaatatccaacaggtggagctcatgcaaatacgttccgtgcgttattgaatgaacttaaactgaagaagaatttcgttcctgatgtcatcattattgactatctgggtatctgtgcttcttgccgtattaaagtttataccgaaaacagctacacattagttaaagctattgcagaagaacttcgtgctctggctgtcgaatctgaaactgttttgtggacagcagctcagacaactcgttcaggttgggatgcttctgacgtttcaatgagtgatgttgcagaatccgcgggtctaccagcaacagcagactttatgctagcggtaattgaaactgaagaacttgctcaacaaggtcaacagctcatcaagcagattaagtctcgttatggcgacaagaacatcaacaataagttcttgattggtgtaagtaaaggcaatcagcgttgggtagaaatagctcaagaacatggtgaacaaccaacttcggtcaaagagacttctggcgctcagcaacgagttgcagaaggtaaccgaatgactcgtgctgaacaaaacgctagtgcaagagctaaactcgatgcattggctgaagacctcaaattctaaccgtttacacgcacatggaagtgtgttactattacctcataccaaacacgaggaaaacatcatggcaatctggacaattgaaaaacttatcgatgaaaccgctcgcactcacaaagcaaatatcctgacaacaccgtttaaagttggttctatagttcgcaaggctgaagacgcaaatttacgttgtgatggtgtaattcgtgaaattctagacaacggtggattggttaaagttattgtacccccttacttagatactagcgaccatgtaacgatgggtatctacgcagcaggtgattttcgtctggttcgcgctagcaattttgtatgcgcataaggcatgtggctctatttgaggaaaataaaatgaaaaaacttgtacttgcattaatctttgctgtatcatcctgctctgctgttccagctatggctaaagcagattacacatcaattccatgcatcaagtttgttgaaggtgactgggacaaagttaagcctaagctgattcatgaccttgaagctggtgcagataagaaccaaaagatgcttatcgaagatctgggtgaaagtgacctggtagtagctggcacaaatctgtattgtgaaaatgcttccgttccagaagttttagagtggattggcttatgatttttgaaggcagagaccttgtagattatcatgacgctgaattggctcagcttcgtttacgttttgaacgtgaaattgaaactggacttactcgttggggatttccggcagaccctcgtgaatcttaccgtaaaggtttaatattggtcgcaattaaaacagagcaggaaagacgatgcacacattcattttaatcatgactcttattagtgaacacggcggagttgctatgaatcaaattgaattcaagccaacacaaaccggcccaactgccgaagaactgtgtaaccaagctggtgaagagtggcgcacttctgctcgtgatttttcaacctctgctaaattcgtttgtgttaaacgataaatagaagaggagactatgtcaactattaaaagcagtattgatgccgtctatgcgtataagtttatccggctaatgcaaaaaccatttactgaatggaaagcatatgaagccaagataatcgatgaaaagggtacggttctgaagcgacctactactccagaagagaaagcggcttatacagctttccacgcatcggttcgttcaatcaaaagaatgttaacaactgttccaggactcaatggagtagcatccatgatgagtgcatggtctgcagtagcttcacgttacaatatcactgaatccgaacaaaaagagatatttgaggctcttcccttgttcgaggacatggtagccggagattccggtggaagtgtccagaatatcgcctctggtaccacaaccggagcaatcaccaataaaggtcctgagaccctaccaaagaaacgtaagcgcatcaaagtaaatctcaataaactgtgatataatggccttagaaataaggccaattcttttggagaataatatgtcatgggtcgacaatgaatttgcataccgcgcattttcacaccttccaagattcaaacaagtaacaaacggtcatcgttttaaactgaatttccgctgtccaatttgcggtgactcacaaaaagaccaattcaaagctcgtggatgggcatatgaacaaccaactggcggaattgtagtccattgctataactgtgatgcacacttaggattagctaaatatctgcgagaaaatgaacctgacttatatcgagagtacattcttgaagttcgtaaagaacaaggtcaagctcgctcagctcctaagaaagaagttaaacttcctccggttgaaaagaagttcattcaaaagcttgattattgtgagcgattagataggctttcaccggctcatccaatatgcaaatacatcgctggacgtaaaattcctaaagataaatggaaccgactgtggtttactactcaatggccggctctcgttaactcagtaaacgaaggtacatactcacatgagaaaaatgaaccgcgcttggttattccaatctttaatgaaaaaggcaaaattgaatccttccaagggcgagccctctcaaaagacgctccccaaaaatacatgacaattaaagctcatgagcttgctacgaaaatttatggtcaagataccgttgaccctaataagctcgtgtttgttatggaaggaccattagatagtttgttcatcaacaatgctatcgcaattactggtggttctattgagttgagcatggttccgtatgaaggtaatcgtgcttggattatggaccatgaaccacgtcatccagatacagtcaagcgcatgaagaagcttattgatgctggagaaagagttgtcttttgggataagtcaccttggtcttcaaaagacgtgaatgacatgattatgaaagagggtgctacacctgaacaaatcatggattacatcaacaacaatatcgaatcaggcttaatggctaagatgagatttactcggtatgctaaaatatgaacatagaacaacatgcctttcttaagttaggtgaagaatgtactgaagtagcaatgctttgctctaagattattcagtttggaattgactcagaatatgaaggcaaaactaatcgtgaaagattaatagctgaattaaacgacattatggggtgtcttctgaatttgcgagtgcatactgattttgatttcgtagaagacagagaagaagtttggaagaaatttgaaaatatggaaaaattccgcaaaatgtctgaaaaccttggattcgttgctaaataaagttaatgatataatttatttctgatttgacaaaaggaaaacacaatggctcactttaatgaatgctcacatctaattgaaggcgcggaccaagcaaacggtgcgtataatgcagtaattgataatcatcaagaccctctgcaagtaatgctcgatatgcagaaatctcttcagattcgtctcgctgaagataaaccattcagtaaccgtcatcccgattctctggaaaccgcaggtgaagtactagcttggttgcgcgctcaagatgactacatcgcagatgaaacacgtgaattgtatactgcacttggtggtatgagcaacggtgaaaaagcagcgtctgctgtgtggaaaccttggaaagctcagcatgtagaaatgcaatctaagaaaattaaagacttatctccagaagaccagcttgaaattaaatttgagttgattgaccagttacacttcttcctgaataaaattatggctcttggcatgacagctgaagaagtattcaaactttattatcttaaaaacgcagagaactttgctcgtcaagaccgaggttattaatgaaatttgattattacgcgtggcagaaagctgggagaccagcttctccagctgaatatagtacggcttatgctgacagagctcattggaagtttaacactcccgaagactatgtagctataaaatccagttttggaaaatgggttatcgcagccaaaggtcaatacacctttgaagttcctaaagagttctttaaacttgaaataactcaacaagagttcatggaacgaagcgaagaacttgttagtcttcatgaaagtttttctgatattgctgttagcggaaatacagaagaaatgaattcagctattgaaactatcagaactaaaaactttgagttacaagttgccagtattattgaataaataaacttgtaactaattaaaggagattacaatggccggttatgtaaacgtaaaaactttcgatcatcagacttctgctggcgaagtaaaaggtaaagaaatttctgtagcatttgaactgtattctgacgttcatcgtattgctaatgctcactaccaagttttcccatctgaaaaaccagcgtattctacggtgtttgaacgaaatcagcgtgacgagtggattgctgctaacgaaactctgtttgatgttacgcctccgtctgaataataagttatagggactccttcgggagtcccttttttgcttttatagagtagtgtataatgacttcactaaatgaggaaaatattatgaatgttaaaacaactccatggcgtaaaccagtaggtgattgtggcggaatcagtgacttggttcgcttaaaatacatagaaaaagaaactaatactgatttctttgtcgatgttaagctacatgcatacagagaagttggaacatctcttgaatgtgctattgaagttctgtattatgatttagttaaagttgatggcgtttacaaaagaaatgtattcaacattcaatttttgaactggagttattgatgattatgaattttgtaagagggttattcggtaatcctcggccagatacccaaatcaaagctgaagaagctcgacttgatgaaagcatcaatcaacatatgtatggagctaatgatatggccgttgcatatgaggaaggcgcaaatgaacaacgtgaatggatttacatgggcgacggaatgatggaagaagtgatagtgaagaaagagaaagttcaacgaaatggacagatttatactggacgcgtaactcatactccagttaatcatcagaatcactctagttcatccagagcatcttattctgatagtccaatgatacatacaacatcatatattgatagtccctcaaatacatcctgtgacactggcggaggcttcacctgtgactgacgaaaaacaatacaaaattactacattcggtctggaatttgtttctcgtgattttccatcgttcactgacaaaagacatcctctctacagaagagaaatcatggtagctatctgctataatccatttttagaatatggaactagctatcgtgacaatgtcgacacaagtgaattgaaaaatggttggcctgaaggtgttgatgttatcatcaaagaatacaacacttatgttaaaaccaaaaactctccatttgacactcaagacagtttcttgcttggtggctggaaaattccacaaactaatctgattgacattattccagaacctaaattcggtgttaaaagtgtcgatactgtgaaaattccaaatatgatgcacactgatgaatacggaactatgaattttaacaattggttaatcacagaccaatttgatatgattctttttcgtagaggtatttggcatctattgggtgttcctaaaacggaggcacttccgcgttgagtaacattttcgatatgtttgaagaagacattcctgaaggatatgtcgaggttgatatgaactctggtccaaaggtggaccagagtatcgctactgagctagaactaatcttcaaaaagcatggggtagattacacaaaacctttatgtgaagaactgtcctcactgtgggcagaccctgcgccttgggctccctgggcaaaataaccgtttacatcccttctcttctgtgttatgatagcttccgtaaaacaaacggaggttatcatggcatcatttcaaagtcctgtcattgaagtagaaatcacaccatcaataccagttccttctggtggaatctatgagtattgggaaggctcagaggaagttgagcgtaaaatgctcgagtctgaagttaactcgatgttcactgatgaagaacaagcagttctatggaagtgtttgaacgataaagtggaagactgggttaatagtgggttggataaagttatccgccgtcgtatgacaactgctactcctgaaatgctttatcgtggtgtcaacagacgaatgctcaatgttcttcaaaacgtcgaagttggagaggtttttacatctgaaagagttgtaagcttttcaaccgactttaacacagcaagaagttttgctagctttggatgctatgggaccaagaccgtcattcgctggtctaaccctgcgatagcttataactatcaggaagatatgctaaagattttagccgcagctccaaattgtgagttcagcgcagcaccttacgaccctttagcaaaaattgaccgtaagaataaaattaacatggtccaggatgaacaggaatggatgatgccaatcggaacgaagttccgagtaactagcattgaggatgtggatttcaatccaggtggaatgcatacaatctatgatgtagaacttatttcattctgaccgtttacaaccggaatcagatgttatagaatactccttgaaaccattataccgctactttcgcaaaagcatataaggatatcatatggccaagccattagaaattgtcgttgcaactcgtttagttaatacttacgcttcagcaacacgccgccaaaaagattttggattgactatggcatatcttgctaacatcgctcaacagaaagtgtgcgcttactcaggtgagccattctgtgaaggtgtcaacgatgacatgatgactcttgagcgttttgacaacgacaaaggatatgtgccgggtaatgtcattccagttaagaagaagtacaactctgctcgtggaaacttctccttagaggagctgattgagaaacgagatgagttagcttctcgtattgttcgtgctgcagatgcgggtggtcacgtcattgtcgaccaacaagaaccagaatctgaagacccgctggcgggtatcgccaaaaagtaccacaagcagtacttggctattctgaacaatatcgctaaacgtgaacagcatatgaagcaaaagggtgtcacggcggaagtgaaaaagtctttacaggctcgtatcactggcggtaaagctgaacttaagcgtcttcgtaaagtttctgggaacactgacaagctggcttcaaaagccgcaactacaagtaaaaaggctacaaaagcagaaaattctgtccataattatgatatagtaattaagggattaactcgcttccagaacttatcttttattgataaagctaagctgaataaaggtctcccattatctgcttcaatgtttcaacttattcgaggtaaaatgtgatgcactatggctacgcgctgattacaaaagataaagatggatttgagattccattctacgaagcatgggatggaaatcctcttggtctttgctttatctttacaaataaaatttcagctgagaaatatatggggactcagcttggaaaactccagcatctgttggaaaatggtcgccaagtagagactcaagtaacaaaatggcttttcttcaaacgtgatattattgaacatataccgctcactgaacaagagcgccgaaatgtgcaacaaatgattaacacattgcaagttaaaaaggttaaagtcgcgtaggagaagttttgaatattacatttgatatgctcaacgaaggccagaaggctacgttcaatcgtgtagttgaacgtattaaagctggtcgtggtggtcacatcactattaatggtcctgccggcacaggtaagaccacgatgacaaagttcatcatcaattatttgatttcaaccggagtatcgggtgtaatgctggctgctcctactcacggagctaaacgagtacttagtaagcttgcaggtatggctgctaacactattcacagcattctgaagattaacccgactacttacgaagaaaacatgctcttcgaacaaagtgaagttccggacatggctaaatgccgagttctaatttgtgatgaagcttcaatgtatgaccgtaagcttttccaaattattatggccagtgttccaagctggtgtctgattatcgctatcggtgataaatctcagattcgtccagtagaaccaggaagcactgttccggctctatctccgttcttcactcataaagattttgagcaactttatctcactgaggtaatgcgaagtaacgctccaatcataaaggtggcaacagatattcgtaatggcgagtggatttatgagcatctcgttgatggtgaaggcgttcatggcttcacctctcaaacagctttacgcgatttcatgatgacatattttgaaaatgtcaaaactatggaagacatgtttgaaaacaggatgctagcatttactaacaagtctgttgacaaattgaactctattattcgtcgaagaatattccaaactgaagagccatttatcgtcggtgaagtggtagtgatgcaggaaccgctcattaaagagttggaatatgacggtaagaagttctctgaggtcatcttcaacaacggtcaatatgttcgtattctttcatgcaaagagtcctcagatttcattggggcgaaaggagttccaggcgaatatatgattcgtcattgggatttagagcttgaaacgtatggtgaagaagatgattactaccgtgaaactatcagagtaattgctgacgaacaagaacaaaataaattccaattcttcttggctaaagcagctgatacttacaagaactggaacaaaggtggtaaagcaccttggaaagatttctgggctgctaaacgtcgttatcataaggtgaaagcacttccatgctcaaccttccacaaagcgcaaggtgtttctgttgataactgctatgtttacactccgtgtattcatatggctgatgctgaattagctcaacagctgctttatgttggcacaactcgtgctcgtaaaaatgtttattatgtgtgaggcttatgtacacaattactgttgaagacgcagaggctattgtagccggcgtcaaagataacatggtgtcaaatccatctactacaactgagcgcggaatcaatatgaaaggcagccagattgtgttggaactaaatgacattatccgagatgctaaagctatttcgtggtatactggctactatccaaagattactttatctgaatttgttgctggtaatctacgtgaatttaaggaaatgacatgattaaagactttattattgactgggagacatttggtaatgtctctcgttctgctgtaattgatgttgcggctgttgtatttgacccaaatccagaagtagttgaaacatttgaagagctggtaaatcgtggaatgaaactgaagtttgatttacgagctcagcaaaaaactcgtcttttcggcgcttctactatgaagtggtggaaatctcaatccgaagaagctcgtaagaacttggctccttctgaccaagacattgaccatgtagaaggtctgtataagttacttcaattcctgaaagacaacggcgtagacccttggaaatctttcggttggtgtcgtggccaatctttcgacttcccaattctcgtagatattctccgcgaaggcgaatctcgcaaaggaattgctgaaaaagatattgatacatttagtctggaaccatgtaaattctggaaccaacgtgatattcgtactgctattgaagctttactgatgactcgtgacttgactacaactcctcttcgtaagggagtcctggacggtttcatcgcgcatgattctattcacgactgtgctaaagacattcttatgttaaaatacgctcaacgctatgctcttggtttagaagatgcgccagaaggtgatgaaattgaccctctgtcgttaccaaaaggccgtggctaatctgctttaacaaaccagtatataattgaattctcttaaatgaaaaggtgataagatggctagtaaaatgattggtaaaagtgtaaaagttattggcggccagaacaaaggtctggtcggttggattgtctctgacaacgtagcccgcggccagtacatcattaatgttgcaggccctactcttggttcaagtggttttaagatttctgctaagtatcatttcgttgaagtaaatgagcctattgatactactcttgttaaagcaaaagctaagtttgaaggtaaaccagtttcagtagatttgaaagatgctttagaaaactcaagcggaaaagatattaatggtatgggtgcttgggtatctctggtctatcgtgatgaagatactgaccaaattgtagccaacgtagtgtttatgggcgaatacgctgtagttcctaccgataacattaaccatgtaatggctggcagcgctcgtccaggacgtgcataaaccgtttacttttccagagggctatgatactatagccctatcaaaacaaatgaggagaaaatcatgaaaaacgaacctatcattaccggcatcactcgtgacgaatttgaagatactctgtacaacccagacttagtagtggttcagaaagatgttgcgggtcacctggagcatactcaaatcgcttatgtttatgaaaatgtaaacgacaaattaccaatctatggtgtgttccgtcaaatctctgatgatggcaccgaatactggaaggaaacttacaatgcctaatttcgttcagcaccgcacttatcgtttacccgaagaaaatgaagagatgttcttatctcatagttttcataaccaaggcattttaaacgaaattaagtcaaaaggtcctgaattcactgttcttgaagtacaagaagaatgtaacggtgattcagcaactaaagtccgttttgaaggaactggtgaaacatcttgggacggattctacattactccagatgaacgtgaatactttgaagatgtaaccaatggaaaggggagctggcgcgcaggagtagtttacaaatgcgtgaatcttcttgctattggcgcatcatcaattaactctcgatttgtcagagaagttggaactaaatcattcaaagtttctaaaatgatgaatgactatgaacgcactttagaaattgaatacatccataatgacggctacacagccaagatgaaaatcacttttacaccaggtgaatatcgttactttgaagtaatttcagatgctgaagaatgtaaagattacagtccaatttgcagcatggaatctttggacgagcagattacggctatgaaagaaccagaagaatgggcagcagaagttgaaggcgtgatggtgttcaaaatcgaaagtgaagctgaacgcaaacaagcaatcgaaattctcaaaaccatgaaatggaagaaataatgcaagtattagatatcactccagtacttcgtgtttcggctaattataccgaacgtaaaccatggcgcaacattacatctgttatgttacagctttcttctgaaactggtgaaatgtgcgactggattaatcgtccgcatcgtcagaaagaaatctttgcaggtgaatgcgctgatgtaatcaactgtgtaatcgatgctctttggctgcatatgcgcgaaaatatggatggagcttctcatgaagaagttgctttagcagttaccgaagagttaaatcgtcaacttcatcttaaaactaaaaagtggtcggaggccgtcaatgccattgtatgattatcagtgtgaagcttgcggcgaaaaatcagaaaagaacgttaaaatttctgagcgtgataatacgcaaccatgtaaattattgaattgcgaaggcgaaatgaaacgagtagtttcagctccagcagttcattatgatggtcttaaaagtggtgattattaatgggtatgcgtccacgcattaaattcatgaaatccggcgaaagccgggttattaaacttcatagcggcaaaattattaaggtgactaagaaatgaaatatatcaatcgtgctattgtagccgctttatttgcttttggtgtagttggatgcacggatgcagataatgctactcgcattcttgaagcaaatgggttcactcaaatcgaaatcactgggtattcttggttctcctgctcagaaaaagatactcaatctaccggatttaaagcagttggccctaccggagtgaaggtagaaggtgctgtttgttctggcatgttattcaaaaactctactatccggtttgaataaaataaatatctgtagactataaggagaacattatggctacagatatttggaccacggtacatcctattccgtggcgtaacacaagttttctttaccttccttggtggattcataacatccttattaaagccaaggaagaaggtaaagactggcgtgaatacgccgaccctcaatatgcacttcaaattgatactctcaaacaagcttatgtagattatggtgaagttaatttcattgaatctaaaaatggctatcaatacacattaagcgaatataatgtagatggtccagaccctcagccaccgctgggaccaatgcttcaacctgttgctgtgatgtcaaatccgcctactcaaaaattgcttaaaggtgttggattatctggaactgctactatagtttctggcggtactggatatgtatttggtgacattgttgatatccctgggacggaaggagatgttcctggacagattcgagtaactgctgttggtagtaatggcgaaattacaacagctcaaattcgcaaacctggtgtatatgcaactgctcctactggtgaaatttcagcaacaggtggtagtggtacaggcgctaaattcactgtaacgactaatgcaggcgtagcttcaacaatttatgctggcgtaacaatttcacgtactgatgctaaaatcacttattggggttctgacatcaaggatgctgtttctggtttcagaggaaatggtactggcaacggaactcaatgtcgagttaatttcaaaactgattcaagcaaaattgatttcaaactcgccgggaataactccaagtatgacctttatgtagatggacaacgcatctctgccacttcagtcaccactgattcgtctggtgcagtttacatctatagcatcgattggaacggtgttgagcaaatgcgtgaatattctcttgttggcgtgaatactgcctttggcggaatttatgtagacactggaaaaactatcactgcaattactcgtccagctaagatgatttggcagcttggtgactcttacacattcggtacaatggcaactcaagcatcgttcaatgacttccgtttctattgtgataagcttggtttagttggattagctgatggcattggtggttctggttggacttcaactacttctactcagcctcaagctcgtatcacagctaagcttgcaactctgagtttcactccggatatcatcactttagctttaggttataatgatgctccagccggaagaattgatttgcttaaaactaacttcagagagtctattgatttaattaagcaatatcaaccacaagctaaaattattgtatttggtccagcaactcctcttggaatgactgaccaaatcgcagcggttcgtgacgcgctgattgaacttacaactgaactcaacttagagttcgtagatgttaaaggttgggttactgcagagaacgcaaatctgtacacttcttccgataatgttcatcctaacgaccaaggctacttctggcgtggttcgcagttcactaacgttctgcaagataaagtataatgaaagggccttcgggccctttgttgtttactttctctacaaattatgatacaatagctctacaaagaggagaacagtatgagattcggtttaactgtagagcataaaaatttgctcaagcaactcaaaattgtgaacagtgcacttggtcactggaagtttgctttttggcctactcgtatagtcgatggaagctatatttggcttgaaaaatactacgagattcgtcatgagcatgttcatcaaaatgaagacggaagctatgagtgcgaagcatattatggtgttgatatgtacgcatacacgaattcccgcgaagtccgtcataagttctataaaaaggtttatggttccgggtcgtgggctgcataccatccaagctataatcctattttcggtgaagaagctaaaacccatttgttgcaatataaagctgaacttgaagaaaaaatctctcggatgtaatgctttaagaattgaatgttagaatgttcacctaaacgaggacaaatgatgattaagaacgaaattaaaattctgtcagaccgagagcatatcattaaacgcagtggaatgtatattggctcttcagctatggaagctcatgaacgttttttgtttggtaaatttcaagcagtaacttacgttcctggtattattaagctgattgacgaaatcattgataactcagtcgatgaagcaattcgtacaaactttaaattcgcaaataaaatttctgttgagcttaaaggcaataaagttattgtaactgataacggacgcggtcttccacaagctccagtagtcactccagaaggtgatgaaattcctggaccagtagctgcttggactcgtccacgagccggtggtaactttggtgatgacgcagaacgtaaaaccggtggtatgaacggtgttggttctgcactgactaatattttctctgtaacttttgcaggagctacttgtgacggacaaaacgaaatcatcgttcgatgctctaatggggctgagaatatctcttgggatagtaagccagcaaaggaaaaagagttcattcaaaccaagaccggaactcgagtatcgttcattcctgacttcagccacttcgaaagttcagggttaactgaagctgacgagtcaattgtatttgaccgtcttcaaactctggcagtagttttcccggatattgaattcaaattccaaggcaaaaaagtcaacggtggatttaagaaattcgctaaacagtttgatgaagaagcagtaattgcagattctgaaaagtgttcaattgcaattggtcgttctgatgatggtttccgtcaactgacttacgtgaacaacatccatacttctaagggtggttctcacgtggacctggttgtcgacgaaatgtcaaatgaacttatcccgatgctcaaacgtaagtacaaactggaagtaaacaaagctcgtatcaaagagtgttttacttttgtgatgtttgttcgcgatatgagcaacatgcgttttgattctcagactaaagaacgtcttacatctccttggggcgaagttaaagctcatttagatttagactacaaaaaacttgctcaacaagttatgaagtctgaagcaattcatatgccgattattgaagctatgctagctcgtaaattggctgctgagaaagctgctgaaactaaagctgcaaaagctgcttcaaaagccaaggttgctaaacatattaaaccagaactttatggcaacgataaagaagaaaccaccttgttcttaacagaaggtgattctgcaatcggctatcttctgaccactcgtgaccgtaaacttcatggtggttatccattgcgtggtaagttcttgaacacatggggaatgactgcagcagaggcaatgaagaacaaagaggtcttcgatatctgcgcaatcactggattgactattggtgaagattatgaaaatctgaactacaaaaacatcgctatcatgactgatgcggatgttgatggaacgggttcaatttacccaagccttctggcattcttcagtaattggcctcgtctttttgaagaaggcagaattcgcttcgtcaaaactcctgttatcatcatgagtaaaggcgaacaacaaaagtggtattacactgcagctgaatatgaagctgaaaagaatgaactcgttggttggaaacttcgttacatcaaaggactaggttctcttgaagaagatgaatatgaacgagtaattcagcaaccccattatgatgtagtttctcttccagaaaactggaaagaactcttcgaaatggttatgggtgacgatgctgctccacgcaaagtctggatgagcgaataaatatatcgggcgtcttgcccgatacaataaggagctattatgtcgcagatttgggtaacattagtagatggaagttacggctacatgtggggagatgctctgccactcccaggtgatactgtcactatccgtgtaagacatactgacggctcttatactaaagtcacaggcattgtttctcgtgcttcgtggtaatgattagggactccttcgggagtcccatttttatgaggtgagcagatgattctagaagatggcactttagtaaatcttgaaaatgtagcagaatgtatcaaacagaacggagaacgacatctagttgagcatggaggttcaccagatgacccctatcacattaaattcgaacaggcaatagattatattgtcaactgtattgaaactcgccagaccattcctatgaaccttcgtacgttcgcgttgaaggtggtttacaatcgccgagaaaagtatacaataaaacaaatggcgaaaatacttaactcaataggaactatcaaatgttaaatctcaaaccttcagctgaactgttcgacgatgctgtctacaaagagtatcgcatcattcaacgattctttgacattggagaagctgaagaattcaaagagcgctttaaagaaattcgtaataaaatttttatcaccgatacggctactgcggaagaacttctggatgtagccaacctaataaaacgacactgtgactgagagatatgaaattaattgctgataatgaagaagttttaggttctgctggtaagaaaactaaattcaccattcaggcttctcccaaggcctttatgattttgtctgataagctctataagaacaaaattcgtgctgttgttcgtgagcttacaaccaactggcttgatgctcacattctgaatggaaagcaagatgttccatgcgaaatcaaatgcccgaataagttagacccgcgtttcattattcgtgacttcggtccgggtatgagtgacttccagattcgtggtaatgacgaagagcctggtttgtacaacagctacttcgcatcaacgaaagcagacagcaacgattttatcggtgcattaggtctgggttcaaaatctccatttagctacaccaagtcattcactatcgtttcttattacgaaggtgaagctcgtggttacatggctgtgatgaacaatggcgaacctgatattcgtcctctgtttgttgagccaatgaaagaaggcgagcagactggtattgaaattactgttcctgttcgtcttgaagacgttgaaaaatttgcgcatgaaattgcttatgtaatgcgtccgatgccagttaaaccaattattactggcgcaaacattcatattgactctttcccacaagatgtagaatggttccattctcccaacggatttggtaaagatgctaagggtctgtatgcagtttatggcaaaattgtttatcctattgaccaattccaaggtcttgaatgttcttggcttctgaatcgctatggatgtgtttacgtcaatttccctcttggtgaacttgatattactccatctcgcgaagagctttcattagacgatgttacaattgaaaacatcaagaaacgagtgaatagcttagaaaaagctactcttgaagctgatattgcgcatcttcaatccattgagaataagcgtgagttggttcgtcagctgtctcaatttgattcaaaccaacgttttattctgaatcgtcagaacattatgtttggtgataagacttatggcgaatgggttgaaacttatagtatcaatgaacttcaaaagaaaattgaagcttcaatgatttatacttatcttgtgaacctggattctgagcgtatgcgtcttactagttcttggtcaacaagaaagcgtatgtcagtttcaaatctgcttaatgttcagcagaataaagttcatatcatgattgacgacaagccttctcggcgagcggcgatgttccgtggaatgtatttgaaagacttccaccgatatcagcgttttatcatgattgaccctgaagaccctaaacatcttgaaatcaaagatgaaattatcaaactgtttgaccaagatgaagtcgtcgttctgaagtcttctgagatggaagaatatcgtaagtttgagaaagagcattactcaaactcatctaaaggagatagtggaccgcgtccaaaatctccaaacggacaactgcataagttagatgctaaaggcggttggtggacttctgaagacctcttcatgaacaaagacgatattgcagaacttgaaggctatgcaattttccgttctcgtgacgagattcgcactttccctgatgaactgtggtggtctggtgtagatattgaaactatcagaactttggctaaagaactgggtgtaactgaattctatgttattcgtccgaactcggctaaggctgctaagttaaatgataatcttgaatccttggaccgtttcattgttgacgagttcatcaagattattgatgacctggattgtgatgaatatctgccaacgtctttctttaaccgccgtgttgtaagcaacattatcaatacacctaagttaaagtggttgttgaaattcattactggcaaagataatggcgaacgagtatctcgcatcaatgaaatcggacgtaatctaaagaacacttatatcgcggcaaattttgacgggtcttcacagattcgtgaagatttagctttatgtattcggatttataataaactcacggatgctgcttcagctgaagtagatgctgcattcaaaaagtttgagaaagaatatcctgtcatcgagcatatgctaaacgaatggcgtgtagctaattatgccgaagatatttcccgtattatgagagcgctggaaggcgctccttccttaaaaggtgaaagtgaagatgagtaagaaagtctctgttgttaaaatgtttgatgcagcgcagaagcgtgaaatctatgatgcttatatgggtggttacacccaagaagaagtcgcaaaattcttcagctgttctatcgacactgtgcgtcgagtagttaaagaaatcaaaactgcagcaagaaacgctactgaagaagtagaagctccaaaggttgaattcagaccagaagatgttgtatgggctggttcttctaagttcctgtctattacttatggccgtgatacttatgcagcagataaagaccatccaaacttcaaacaagctcttcagttgtgtgttgatggcgaatttgaagaagcgattaatctaattaacattgagaaggcaatcacttcttatgttgacggtaacattcgcattgaaaatggtcagctgttctatcaggacattgaaatcaaatctggtctggttgaccgcatcatcaatgatatgcagaatggcgaagactttgaattctatctgccgttcctggaaaatctgctggaaaacccaagtaaaaccgcagtgactcgtctgtttgacttcctggaagcaaacgatattgaaatcaccgaagatggtcatttcctggcatggaaagttattcgcaacgattacactgactgttataccggtaagtttgataactctgtcggacgagtagttaaaatgcctcgtactcacgtagttgaagacgaaaacctaacatgtgaagccggtctgcacgtttgcgctcgtagttacattaaacacttccgttatggtgattctcgtctggtagttgttaaagttcatccgcgagatgtggtatctatcccggtagattacaacaacgccaaaatgcgtacttgtcagtacaaagtaatccgtgaagcggaatacaacgaagaaactgattcatacatctaatgtaagggccttcgggccctttatttttgaggaagccgttatgattaatccattcaacgtaagtgactcagcagttgttaatcttcgtggtgaccattatgctaaatcagtttattgccgtaaacttgtaaagcatccaggagatgttcattatgcttggttgcactgtgacgaagtagttaatgaaatccctcctatcgacgcagaatatcttgaagaggatgaccgcatttattttggtgaactacatatcagaggaatttatggaaaagacgaatcccggcctattgagattgaaaagcctgaagacttttacccgggcgttcagtgatttaacaccagaagatagagtcaaaatcaaaagtactgctgcttattctcttcgtcaagacccagaccaagataaaactgctgtaataaatcgctgtgcaattgcacagctggctgaaaaagcagtagctgattggatggacggatatgttgcaggcggtcaagaaaatcatgatgacccttacacgtatgcatgggatgttcttgctcacccaagattctgtggtctccgagttgaagtcaaaactcatcagtcagattcaaagtggatttctgtcacaaccggatactctggagactatcctggtggctcagggataaacctaggacccttcttgacacacagagtagcggactgtattatcatattagatgtagtagaaagtgggcctagtgtttaccagtttaccctaaagtttgctggagaccacgaagacctcaaatcagttgttcgtaagagtaactaccagggctggtatctaaatctttaatctctgccgtttacattctccgtttaatggtatactatagactagaaatcaactaacggagaaacaaatgaacatcatcaaaaagattcttaaagctatctggactttaactcttctgatggtgctctttggagccttcgcattcgccttagcacatgatgtagtaatggcatggattaacttttgaggaaaatattatgcgtcgcaagactacctttggttctcgtatggataaaatggaaaagattttctggattttcttttctgttgtagttgttctaattgttgctggaattggttttagcatttgggctactgttgagattgtccaagcagtacaaactgatgggctcaagagtgtagtagaagttctgtggaacggggctcagcaaggtactgaattatgaaaatcttaaaattctggtatactggtattatttttactacagcggcttacgttggattcaatttggcatattggcttggcttaagcagttatgaactagtgtttgaaattgttaaacattaattcagggccttcgggccctatgaggataaacttttaattgattgaggaaaatgatatgcgtgattatatgactcgtggtgaccttgaagctgttggtgcaactgttgtatgtgctgttaaaaacggcgaaactgtaggttacgttgacccatctgttctggctgaacctggcttctacttcatggtaaaaggtgcttcagcttggcgtgcagtagcagcacgattctacgtcggccgtcagcgttcaaaatctggtttcatgaatgttctgtcacagattcgtcaaggccgttctcagcttggtcgtactatgcgttcaaataacgtcatttacgatgtgtacttcatcccagctgataaaatgaagcctctgactactggcttcggtaaaggtcaattggctctggcattcactcgtaagcacaatgattcttaccagaacctggaagaaatgaatcgtatgcttaatgataacttcaaatttattcttcaggcatattaatatgagtccattcaaacagatttgggctttgatattcttgctcatggcgccgctgttcattgcctctggtatttttatctgggaggggttaacccctccaccaagagtcattggaagcatgtgctttggcgtagctgcattggctgtagaacgtttgttctattacacaggcttaataaaatgaaactcgcaataggcgttattggtgtgtcaatattactctccggcgctttagccggagcagtttatgtgatgggcgaaatagtgctttttcttgctcgtgttatgatgaacatcggtaatttaatctggtagggtaatatgacaactattttcgacatgatgtctaaacaactcgatgattctgttggtcagctcaatatgagaaaccttcaaagcatcattgataatgaagctaaagaattcgcaatctacacggtagaaaaccgcgcaattcctaacttgattgatggtttcaaaccggttcaacgatttgttattgctcgtgcactagatttgtctcgtggtaataaagaaaaattccataaacttgcttcagtagctggcggtgttgcagacctcggttatcaccatggtgaaggttcagcacaggatgctggcgcgctgatggctaacacgtggaacaacaactatcctcttttggatggtcaaggtaactttggttctcgtttagttcaaaaggcagcagcatctcgttatattttctgccgcatttctgacaatttccgtaaagtctataaagatactgaaattgcgccggaacataaagataaagagcatgtaccacctgcattctatcttccaattattccaactgttcttctgaatggtgtgcagggaattgcaactggttatgctactaagattcttccgcataattttgaatcagtagttgaatgcactaaattggctcttcaaggaaagctggataaagaaccagaagttcaaattccacaattccgtggtgaagtagttcgtcttgaagatgggtcaattgaatgtcgtggtctttacaaattcacttctgcgtctcagatgtacatcagtgaaattccagctaagtttgaccgcgaaacttatgtagaaaaagtgcttgaaccaatggtagataagaacttcatctcttacgttgatgattgttcaaagaccggctttggttttaaagtgaagttcaagaaagattatatgcttggccaagacgatgagcagcggcatgagaaaatcatgcgtgacttcaaattggttgagaagatgtctcaattcatcgtagtcattgatgaaaacggaaagttaaacgataagttccaaagttcttctgaacttatcaagcactttgtggaagttcgtaagacttacattgtcaaacgaattgaacacaaggtcaaagaatgcgatgaagcattcaaattggctttggctaaagcgatgttcatcaaagaagttattgaaggtagtattgtcattcaaggcaaaactcgtaaacaactgacttctgaacttgaatctcgtccaacctatgcaccatttgttgacaagttagtgtcaatgaacatctatcacatcacaagtgacgaagcaaagaaacttgctcaacaagctaaagacctgaaagctgagctaaagtactggcaagaaactactccagaaattgagtatatgaaggacctagaggctctttaagagcttctgtatcactctaaacggctctagttaattctagagccgagtccatataattaatcatcctttctacgcacaatccctcaaccgttctggttaactttaaaaattctttaactcaaccgtttacatcatcgtttgcttatggtattatagctctatcaaaaccaaacggagtaaacaaaatgatttcaattatcgttgctgccttaacaaatgctggtattatcgcggaaacttctgatttcgcttatgttaaatttaacagaatgtcaattgacaagaatactcaagcacgttattgggctatggtttatgaccataatgaaagtcaatacattttaactgaagttctgattgatttagaaactttagaggcggacttcgcaggatgccctgaacttgaaggcgaatttgaagaagtcttagaagcttatgttgcaaaatgaggaaattatggaaactttaatcaataacttaaatgctttactggctaactcaggtgttgaccttgacgacgcaatgcatgcagcacgccttcactcatcaaacactgatagcaatagctatctgacaatttggtataacagcgaaagcgaaaactacgtgctggtatgggtatatgtcaacaactatgacatgactgcagtgcttgatgcagaagttgaagatgttgctgaaactctgaacgaagcgaagaagctcttcgcagacttcttccgaggttaagctgtttgatagcatctttttcggaagatgctaaactaaccgtttacatcggcttaaaagtttgatactattatctcatcaaaacaaatacagaacctggagaaacaaaatgtctaaagtaatctatatcgttaaagcttctgaaaactctatctctgaaaatgctgcaaacgttctgattgtagtcgccaagaaagacttcatcacttcttccgaagttcgtgacgttctggcagataaactttcagctgcttcagttaacagcaacatcggtgttctgattaagaaaggtctgattgaaaaatcaggtgatggtctgattgtatctgctgaaggtcaagaaatcatcaaccaggcagcagttatctacgcagaagaaaatgcaccagaacttctagaaaaacgtaacactcgtaaagctcgtccgattactgaccagatggaagcagacaaaaatctgatgatggagcttctggcaaccaaagataatctgttcacaatcaaaaaactggacgtctatcgtagcaacttcatcgcggtacttgaaaaacgcactttcggtattcgtagcttcgaggtatcaaacaaaggtaacttccgtatctccggttacaaaatgactgaagaacaagttaaacacttcgaagacctcggaatggttgctaaacattctaaaaatggcaatgtatacctggacattccacgtactcaggaaaacattgaaaacatcatccacgctgttgacactctgtaataaggaaattaaagatgaaaaacttaaactctcatgtacttcatgttaaaaagctaatgaatcgtccagaaactttgaatgaactgcagcgttgtattgaacgagtaactgataagtactatttgccaaccgatgcgtgggaagtctggttccgtggaacacatcttggcagtattgaacttaaagctaaaaatgtttacgcagtttatagttctcatggtcgtcactgcggtgaacattctaacttcatgaaagcactcgcagaattcatagattcatgtgcggtggttatcgcctatgatgaaattaaagcaacagaagaatggattaaagaagttactaaagaacctgaacttcgtacttggggtctccgcgaaccaaaaacaatctggcagaaaattaaaggattcttcaaatgagcaaattttcagaacaaatgaataaatttgtagaagcagctcaaaacggtgatttaatcgaaactcagaatgtcaatgaacggattcctgaaatctgtttcgttaaagccgattggtgggatggtcgtttacttcaacgagttatcgtctgtgcagctaatcgttttaaattgaaagatggcggagagttagttattccagggactcgtcattattcaaaagatatggctctggtgttagaccaaatgcgtgataaagtggtttctgaacaggtttatggtgatgaccaaggtttcttggaccaatggggaaattattttactcgaaaagaagcattaatcattgcaactcatgctggtcaaattaatactcgtcgtgttaaaagtgggcctgctgatacattattctccgaggatttatactaatgaaaatggatattaagttgcttcaaattgaatctatgcgtaatcaaatcaacgctcttaaaaaagcaaacgaaatgatgcatgaacaatggacttcattaacaaacgaatcaggttggtcttggttatcagaagctgtcgtgaagaagctgacaattaataatgatccatggatgtggaatggaaccattaagccattgtttgcacaatattatgttatgcttaaccttgaaatgattaaagaacttgaacgccaaattaagaaactcgaggaacaagatgaacaatccagtagcaaagcatgatttcaataaaggcggcgctcataaagatatgaagcgccaggaaaaagaatctcgtcgtaagcaaaaacataagggaaaagattatgaataaaatttctcatatcgaagcagaacgtaaagcatgggatgaacacaccagtgttgtagatgcaataactccggtgtatcatcttgtagtatggttctctttgactcgagaggaccaagattgctcttggaaatattttgaagatacaacatttcaaaaatttgtcaacgctattaatcatccagaatctctactcactcattgtgaaataaaagcaagtgaagaaacattttgttatttcactgtaagttctaagcgtggtctttctgacgtcatgcaaggttatcaatttctcaaaggtgttgctgacgaatttgaattgaaaatcaattacgagaaaatttaatgaaccagacagtagagattcaacgctatctcgaaggaatgatgaacaagcttgcacttggtgacatggtagattacagctatcaagaggccatggagatttgtcactggatgaaacgtagggttcgtgtagtaggagccgaatggtatatatcagctgagttgattgatggtcgctacgccattcgctatgactctggtgacgaatacgtaactttacctggccatgtacttcaacgctgggaagtggtgaactgaccgtttacattcaccgttgactgtgttactatatcctcaatccattaagtcgtaggaaatacttgatatgtctaaaattgaaattgttcgcgaaattgttactgtggcttctgtattgattaaatttggttctgaacacattcttgaaaaacgtgaacattttattgcatttttgaatgaaatcggaattaagaatgatttaggtcgtcctctgaatcagagtaacttccgtaaaatgattgaagaaatgacagctgaagaaaaacaacagctagttgaagagtttaatgaaggttttgaatcggtatatcgttatatgatgatgtacagtaagccgtaacatccttgttacttggctcttcctaaagttctagcagcttgactacaaattgcagccaatctattttcatttaagagtggtttgctataccagtacatggaaactgttccggcataaacgttgtccaggttgaaatacgggcacgagtacatgtacttcaactccccatcctttttcttagttggcaagaaaacaaattcattctcagaagagaaatatgcacctctcaaatgagcagaatattcgtttgaagtcttatcaactggaaatcctcccaaatttttttcattgactgcgctaggcaggcgcccttcatatgcaattaaatccacaaagtaatttaagttgcgtggtctaaatgagtaaattgcggaaaaatctgcattgctcgaaacgtgagctatctgtagttgttctagagctgatgcttcaaatttagcctctttatcttgttgcaggactttagtgtacgtctcgtaacgagactctttccacacttgcataatagaatctaaacgataccatgtaagtgaaagaatgaaaacaactacaagcgcaacaacccgggaagcaagtaccctcccggttgcgttatctttgaagagtctgtctagaacaccaaataaaatgtcagatattcctggtagtggtgttctctgggtcatataccctccttttcaagggtatttatgctttaaactcttgagccatagacgctaccaactttaatccaagttggagcatttccatatactgctgctccggctgcaccacctggaaggttagtaaccttaccaccaccattagtaccagatgcacctggacgtccaacatcacctccagcaccaccagtagtcttataacgagtttgcggaggagttggacccggtgcggttaaggttgccgctataccatcatgtgaatctcgaccggatgctataccagcagccccgaatggcctaccacctgaaccaccagaaactacacttgttaattttacaccgccgccaccgccgccaccaccacaaatagcagcgttattttcaatacgaagacgtgttccgaaactgtttaaaattgcgggaccaccaggttgacctgatgtttgcccattactacaacctgcaccacccctaccatatacgttagcattaactcgtaaatgaacatattcatttggtaagttagatggaaattctaaacaaggaacaccagtattttgagcaaccaaatcacctgaaataacgactacagcaggagttgaacccaatgcacgaagtttattaatcaggtcgtttcggtcatagttgtggttagcgcctaaagttatagttatttctttagagcgtccaatcatagaagacatcataaatggaacactcattcttaagacagttcctgcttgggacatccattctttgcctgtctcgtttttagctgaactgccaaccatagggcctgttactgccatattaaatcctcaggggcgtaaagcccctcttaatttatttagattcaagttctttaattctagaattaagctctttgatactttctactaaaagtgctatggttgcggaactagagatagttttagttccatcagaaagttctgaaactgcttcaggaagtactttttctaattcttgcgcaatcaatccagcttcatgagagttgtactctgaatcatttaaagattgttttttatcatagacgtagccatttagcttttctactttatcagtagcactttctattttaactaaattagttttcaatcttatatcagaacgaattctaacatcgttaaaatcaccattaccgctagcataaaaagtaccgcctacttggaattgccaatctccaccatcaacacctaagttgattcttaaaggattagcaccagcatctttgtaaataaaggcatctgcacccctagaatcctgaaatcttatatgtcgacgagcgtttttacttaattctatatcattataagtcctaacgttatcggcactaatccagttagtaactcttaatgcgccggtcatagtatcgccagacttagaaacgttttgaccgtgaacccagcttaaagcatcaccaacccattctgacccgccaaaggatttccaacgcgaaccttttaagttaccatcgtttgctaaacatgcacctaagctaccccaagaaatagcatcacctgctgtactatttactgtaagacctgaagcatgagtcacaactaatggagtacctatagtaacttggccggttgtgttacttattgttaacggacgaagaccgttccatgtgcccatttggtcaccagagttggtcaacatgaaataagtattgccaccatcattacggataaagaacccgtagctaccatatgcaatacggaaaccatcagagtttttagatacgaattgagaaggaattccagttttcaaataatcttctgttacaacccggtcccacggtttccatgcttcagaactatatttcgcacgtaagtatacacgagtactgttataaacgtgatatcgctgttgaacacccgcaccagaagtaactgttaaatgacctgcgagtgcttcaggatagttcaaagccaaagatgtgttcgcattagcatgctgagcatattcaccagcatggttatcgccagctagcgtatctaagttcacgttggcgccgagttgtaacaaattctgataacgtgaatcgaagttactatagttagaaggctgaacttgaccagtagatgatatgttgccaccaactgacaatccacctttactaatatagacaccactatccatgtcaaaatttgcacttccacggccgcgaaaataatgataatacttactacccgaattgtaaccaatcagagttacgccattaccaccggcattatttccgtctaatgaagtgtcaatttctaataacgcattattagccggaggaaacaagttgtctgagttattatcgctgtgcactattttagtacactttttaatataaaacggttttatggctgaattgtatatgtcaactattttctgggaatttgacataatactaaaagcaccatcaccagtccatttaaacccggtgtcattatcaccaagagcaatagaagaatcccccattccagagtattctccaagattattagcaccgatcattaaagaaccagtataaaaaccatgacctttggcaccacgacttgctaaagaatacagcttattttcgggaccagaacctgtataccaaacgttttcagcgccagttctttcatcaataatgttatgccaaatagttccttctatatttgcacgacctttatacacgtagtttaaagcacctgatgcctttgtgtaagttactgagtcgtcccaactatattgctgtgcaccaaaaggtttatatgccgtaaaaagacggttcgtattcatagtaggagcaatagattcgatgctcagacgagagcgttgagcatataaatctcttggtgcagtgaaatccccagcaccgttccagaaaaatactgcgttcccgctatcagaggcagatccgttttgaacacgtaaggcaatttgaccagacgaagcagtttgtgaatctgcatataaaatggcgcgctcatagtttttagaagtagatacttcttcgccctggaatcgtaaatgagcatttgaagaactagaagcttttgctctaaatgcacctatatttgaaacaacttcagcaccagctgtaatacctgtagtggcgtttaaattacgaactaaaacatccccagtagtgctgaaattaccggtttgggtgtaattacctacttgtgtaacatcaccatcgattctaccgcctttagcaaaaccgaggtcaataatttgtccgtcagcgttcttagtgaataaagttgaatctttgatgttaattgctaattcgccttctgcgatatcagcaggaagcggtcttttaccagcaacattagaacgcttaaattgaatttgtttgatagttgccataaattcctcaataggttccgaaatcttgaatagagtctcttacgacaatctggtcaaaacgtggaacgtgttgtggtgcagaagctgcgtttaaagaacttaagttcggtgcagccaatggaccagccattgtttgtaacgtagttgtatttattttcacctgggcgtcattacttacatttcctaaaccaacgtcaacgttatttggcttatttccaggtgaataaactcgaccagcttcgtcgtataaaaacttacctaagacatctcccatcacaataagacggggcttagtcatgtcagttactgggtcaaaaattacaaatggtttgccttcgccagtctcaaaagcaaattgagcaggaactttgattgaagcagtataagttgctccagctgttccagtggctttgcctattgtaacagtcgctcctttatcatccaggaaagttaatccctgactgaattgaactggttttgcataaatgccgccattagctttagaaacgaagtcgttatctgcagcttgtggcttatcatattctgtgtagactttataagtcttgtaaagcagagtatcgtttattggaaaaagagggaaactcccctggtgccaaatcggtaatccgccaattgtactgttagcttttaaatcagccatggccttccccttatatgtttgttgtatttattcagaaacaacaaaagccccgaagggctttagtcattatactctctgaagtcagccgagtagatattaccagatttatcgtcttccgtatcaggaagaactaacagtgtattttcatctacaccatcagaaatcatattgttcattctgattccgtttacaccaaatccagccgggtccataagaggttctacagctctcgatacttgagtgagcatcatttcacgaatagcaccgcttccttcagaaccagctacttctggataacgagaagcaattattgtaaatccatcagcattatcaggaacggttacatatctctggtgccacatccatttatctgcgtcagtcggttgtgtttcaactactgctccagaaagatatgaagtgccttggaaccaacgaagatttactctaatgttttgtcctggagctgttaaagaagaatctccttttacttcaaagttccactgcattttatctccaggagcaattccgtattgatttattggagatatttgctcaagctgttgtggaaatcttttacttggattatctttatcaatgatatatgtgtttgaatcatcaatagctttttgtgaatatccagtagctccgatatcatttgctttatcataaatgaattctaaagctggacgtatgtctctattctcttttttgaaatctgaatatgttgcgttttcagcaattattttctttcttcgaatagagtacaaagcacagtaattgcatccataatttgtagtaagaaatatacttggccacataactgaaccaagagatttcatcaaagcatctacagaagggcttgaataaagcctctcatatgatgtaatgataagcaaattatcagaagccgggagggtttgcatatgctgcacaaatgctttagtagccgcgtttgtgtcttcaggctttaaattaaaagttttgaagttaagcatttgattagttgctggattaaattctctcaggtttatacctgggccgtcatattgaaccccagcaggttcatcctggaaagtataataagcttgagaaggggtagactgagctacccctgcagcgaatgctagcttatatttgacggaattgttctctgacagaacttgagtttggacaaatccttgtccaaaactcgccatcattttttgtgccattattcgtcaatccaaatgaaatcgacagtacgagtggtttcattaggaacaatacgaacgttcttaatttgtaaccaatcacggattgtcaagttattgaacgctgaaccggatgttgatacagcaccgatttctccagcagttggacgctgaactgaagtgtacattttaccaaattcgtcccattcaccagttacgatgttaaagttacgaatccagaaagtctgagcattgtggtttaattctgctacagttggacgaggagcccaaatctgataaacagcagttttgccaataccatgctgtgttaatacaccaggaccttttacatactcataatggtccacaaatccagtgtcttgaccttggtcgtctttttccattactggaacgccatagccaggaagcttattataaatcgccgccgtggtaattgatgctgaccaagaagctgggttatcatctgatggtttaacatcaggagcaactttaccttcaggaatttgcaccgttaaaggagcttgaatctgaagaggtccagtcattgaatcacctgctttcttaacgaacccttgagccgttatttcaaaagcatttttagtgttcagaatcgtgtacgtaccagaagggtctactactgagaatgtcttagcatctttattctgcaatgttacttgcttagattgagtaccaatgacaatttcagtagaggaaggattgataaccattgtaccaccttcaactgaaaagcccttattagcgtcaactttgttcattgccgtcagagtctgagcaaccgttacgtttccattacgattaagcgtcagaactttatctgtagcagtaaaatcaagagttgaaccattcgccagagtttcaatgttccaaccattcgccagagtattcaaattgattctagaattacccagggtgtcaccaatatcaacagatatagtagcattcacggtagtgaatttggccgtactagaggacaccagaggagcttctagagtaacatcctttttgaatgtaattttgccattaactacttggtcgatatcgcggcggacgaactgagttgaatcaattccatccagtaaatccgaatcaacagcttttgctttagccggtaagaagtattgcagagcacggttcatctcatatggagatactgcataaccttctttaggcaaatctgttaaagcgggttcgttaattaaatcacctggaagcagacgaccagaaccatttaaagtatcacccttaaaggtgagtgctttttctgacaatttaacgaaaccacgctgagctatagtagattcccaagttttttcttcttggacaatatacttaaagttcttaggagaaactgctttattagcaatagtaccggctaccgtttcagcttggttagcaacttgaataataccttcggtagtttcagtagctttcttagcatgcaatttcttaggcgtaacaatcgtcttatcatcagtaccagcatcaacttgtacctgagtggccagagcagcagtaccacgctgagtctcagatgcttctttgatatctaatgtataatggtcccacaaggttccttgctcaactaatccagacagagcaacaacagatgttctatcggttgaattgaaacgagttttaacctttaatggagttacgatacgtgtatcgtccgttccggtatcaaattcaacttgagttgcaatttcagcaataccacttaaatcttcacgagccttacggtcattcagagttttaggagtaacagctttattgtaattagtaccagcatctacttcagtttgtttagcaatctgaataagaccaattcttccgtcagtagttgttttaccatgaagagtttcaggagtaactacaacagggaaaccaggctgtgccggaccaccggcaattacttcattttgagttgcaagataaacaccgccctgagcttgctcagtagacttgaattggaacaacgattttggagttaccgcatcaatgttgttatcataatcataaacgttagtacctttagtatcacgtccaatacccgcaagagttccagtcgttctgactaatttaagaataccagtcaaaatctcagaagcaatacggttatgcagcttcttcggagtgatgatgcgttcatcgtctgttgaaccatttgcttctgcttgagtagcagtttcagcaacaccacgacgagtttctgttgctgttttttcattcagcatcgcaggagtgacaataacatcatccaaatgcggcccaggagttagagcttggatttcagttaaagtaactaaacgagcaataccacgacgaactttagtagcaacacggtttgccagagtttgaggagtaattgctaactctttttctggattattttcgtggtcaacatttgcttggtcttgacttgctaatgcaataacacctaagcgtttacgagtttcgttatctttagagtcaacacgctctacggtcggaatattatcagcaacaatccagtatttacttccagcatgttcaatataagataattgcaatactggaacataagaagtagtaccgtcaaaagtaagaacatcattcattacccaagtggtatcaggcggatactctgagcgtttagggaattgcagtaattgaagacttgaagcaattttatctccagtagctgctctgatatttactttctgtcctttgcgcatataattcattgcaatagtgacagtatcgccaatagcaatatcagtaggtaaagttatatcaatagttttctgagtgctgttatttacaccaaaaacagtaacaacctcgtttggaattaaagttacgttgtcggtgatcacacgcatgcgcggacgtaagtcgccttcccagattctccagattgactctgattcatcatatacaatgaatccgtcaccagaagtacgaacctctatagatttttgaccaacagtaccgatattggtgttatcatcgaaagtactaacaatcatatggaattgagggttctttccatcaaggtcagtaaagttgatgatatctccagtgtttgcatgtttaggcaaagtaacacggattgggtctggagaagtatatctgcgaactataaagtcgttagattgagcttgaacaactgcgcttggtgttacaatacgagcaactcgttcgtaatcagaaacgtaaagattccacaatctattgctgaacacaaacacatattgagacagtggatgagtcattttgactgagcgaactttattcgtagggccacgcaacacaatgtcttgaatagatgcgttgatagttacaccaacggtaccggttttattaccgatatccttcagcataattgtatcaccatcttgcggattatttggtaaagtgaaaatcatgtcattaccttttgcggtatcgacagaaataaattcacctgattttaaaattgttgttccgcttgaaactacacgccattttgcgtcggtacgaaccgaagtccaataaagctcattaaaattgccagcaggttttgcaatatcacgatttgaaacccaaatgcggttgtcgtaaattactgcgaaaccggaagtgtaaccacgagtagaatcatactgttgtaatgtgttttcttggataaggaattcaacgttgacgccatcggataacaccgtgcggtcagcagtagcaacgttgactattttttcacccgcagcatcgaagccgtcagcgccacgaaacttgcgtttgattgaatctgccataatggtgctcctatttgctattatagaacttatttataatgactctgttactaaatgaacgaggttctaatgtctaatttaaactgtctgttcgacgaagaagaccaagtaaaagatggttacattctagtcgacttgtctcaaatcgcattggcgacggcgatgcacaccttcaaagataaagagaaaatcactactccgatgcttcgtcatctggtattgagcactctgaaatttaacgcattcaaattccgtaaagatggttacaacaaggtgattatttgttgtgataatgctaagtccggttattggcgtcgtgataaagcttattactacaaaaagaaccgtgcagatggccgcgaagaatctgaatgggactgggaaggttacttcgaaggtattcgtactgtaatcgaagaatttgaaaagtacatgccttatcatatgatgaatattgataaaatggaagcggatgaccatattgcggtcctcactaaaaagctttcgttagaaggtaataaagtacttatcgtttcatcggatggtgactttactcagttgcacaaatatccgaatgtaactcagtggtctccaatgcagaagaaattcgttaaagcgaaaacaggttctcctgcacttgactgcatgatgaaagtagttaaaggcgataagaaagataacgttgcagcaattactgtacgttctgatttctggtatactcgtgtagatggtgaacgtactccacctactaaaactgcttttgttgaacagtgttgtgacgctgaagatatcaccacaattcttgaaggtgagcagctcaaacgtttctatgaaaaccgagtgcttatcgacttcgattatattccagaagatattgctaatcaaattctggattattataactcttataaagtacctccacgtggtaaaatctatccttacttcgtgaaatcaggactttcaaaattaaccaaaaacgttaacgatttctgaggaaattatggctaaagaaaagaaagaaccagttgaatttgacgaagcagtacatggtgctgacctcaagaaactaattgttgaagctgctgaccataaactgaaaatctccggtttccaggttctaatcaaagacattcgtgaccgcgctaaagatgaacttggcgttgacggcaagatgtttaaccgactgctgactctgtacttcaaatctgctcgtgatgaatttgaagccgaaactgaagaggcgattgagctgtatgacactgttttccctaaatgatgaaactccggctgaaaagccggattctgttactacattagtagataaacagaacaatggcttcgctatcgaagctttagttaatgaacatggaatgagttatcttgaagctgctacacattggttagaagaaaattctttccccgaaactgcattcgctaaatatattcctggtaatataattgaaaagattatgagcgaagcattagacgataatttattgcgtccatcctttagtaaacagcaaaagacaaatacactcgatttcctgttatgattaaattgcgcatgccaccaaatggtggacgatatatcgacggtaagtctgtgtacaagttgtacttgatgttgaagaatcacttcaacggtcgatatgatgttgtcaagtacaactggtgcatgcgagtatcagataaggcttacgataaacgtcgtgacaaatacttcttcaagaagttatctgagaagtacacattaaaagaattgaccttgatattcatcagtaacctggtagctaaccaggacgcttggattggtgaaatttccgatgcagatgcgttagtgttttatcgtgaatatattggtaagctgaaattaatcaagtcgaacttcgaagaagatgttcgcaatatttactatttcagcaagaaagttgaagttaaatcgcttaatgaattatttgattataatgataaggttaactcgtcatacatattcaaattacttcaaagtaatatcatttctttcgagacttttataattctggactcgtttctggacattataaataaacatgaccaagcaaccgataatctggtctggtcaaactactctacaaagttacatgcgtatcgaaagatacttaatgttgaccgcgaagaagcaaaacaactgttcataaaaactgtcaaaaactgtaaatattaaggtaaaaatctatgtttaagcgtaaaaatcctgctgccctggcttcccaactggcttccctgtctggttctaaaggtttcaattccgaagataaaggtgaatggaaactgaagttggataatgctggtaacggtcaagcggtcatccgtttcctgccaggtaaaggtgatgaaggcgtaccattcgctgttctagtgaatcacggcttcaagaaaggtggtaaatggtacattgaaaactgtacttctacccacggtgattatgattcttgcccagtatgtcaatatctgtccaagaatgattcatataacaccaacaatgaagaatacaagctgttgaaacgcaaaacttcttactacgcgaacatcctggttgttaaagaccctgctgctccagaaaacgaaggtaaagtcttcaaatatcgtttcggtaagaaaatttgggacaaaatcaatgcaatggttgccgttgacgttgaaatgggcgaaactccaatcgacgtaacttgtgcgtttgaaggtgctaacttcgttctgaaagttaagaaagtatctggtttcagcaactacgatgaatccaagttcctgggccaatctgagattcctaatatcgaagatgaagcttatcagaatgaactgcaggaacaaatggttgacctgaccaccctgactgcgaaagaccagttcaaatctttcgaagataaccagaagaaattccttcaggttatgggtacagctgctatgggtactgccgcgtctcgagcatctgctcaggctgataaggttggtgaagacctggacaactttgaagatgaacttgcgaatttcaacgctggttctcagaaatcagcaccggctgaagacttcatggaaactggcggttctgcctccagcggtgatgaagacctcgacgaattgctgaatggtctgtaataaaaagaaggagccttcgggctccttttgttgtttctggactcgtaacgtatacgttacattaacctcccaattcccacctaaagtaacttttacgttacgttaattctgccgtttacatccgctttaagctgtgttactatactcttacaccaaccaaatggagtaaaacaaaatggcacatatttatctcggcgttgcagatgaagaacatttcgaaaatgaagttgagaagtttggtttagaatgtaaatttgcaggtgatatcgcatggggctttgaatataaagtttctggttctcatgaagcaatcgttaaattcttgactgaatcatactgcgtcggcgcggatgaagatggcgaattcctggctgacactatctctgaaatttgcaactaaccgtttacatcgccacatggatgtggtattatagcactatcaaaacaacagagagtaaattatgaaacagcttgtaattgatatcgtatgcgaactcgttaaagaaaatggcaaagtggttgatttacagtttgatgatggctctcgtttcaatagcccgtttagtggtttgaaatttgaagttgtaaacgaaagcgggcaaggcggcggatggccagaaattaagcttattggtcaccaagtagacattggtctttgggttaagaatttttatgcccaagatgaagaagactatgaatacatcatggaaatgatggaagattacactgcttaacaacgggccttcgggccctttggagattaaaatgttttacgttctttctgaagattatagctacgatggcagcaaaaacatctgggctggtaacaacttggttcaattgtttgaccgagcttctacaccgaaatgtattcagctcgttaaagatgagtgctatgacttggtaattgaagtgttctctcttgaaggcaaaatggttaagcatgtgtatgttgaagaaaagcacatgaaatcatttgatgctttcaaaaagttgctaaaagtagacgactaaccgtttacatcagggctatggtgtgttactatagccctatcaaaacaaaggagaacaaaatgaaacttcaacgtcaatcaattaaactcggaagtgaatacaatggcaagtggtactttatcatcgaagggaacgacccggaagctattgaagctgctgaagaccgtcttcgcgaaatggaaactggtgctgttcgtggtgatggtttggtacttacttgggacaattactgcgatggctgtccctgctataacgatggctttggtagcggtttttggattgaaatttctgaagtcgaagctttcaaagctgcctggaaaattgctaaaaaggaaccaaaataatgtctaacgatattcactcaattgcgtatcctaaagttaaagtacgctgtcagtttgagaattttcctggtgtgtcttggattactatggagtttgacccgcactcccgtggtaaccgagtgtcaggcataattgaaaccggctatggcaccttcccgctggatgaccaaatcatcaacggttatcttcagcgtcagaaagtaggtgcggctttcatcttcactaaaacagcatttgaagaactcgctggtgctgttgaagatggaatggaaatgatgcgtcgtcttgtaagggctgctggttatgattcgaattctttctgattgggaatgcaagtattgcggtgccgggttgtggtcacttggcggtaaatgctttaaatgtggaatgaggcaggggtaatgattcaattaatttatgcttattgtggaacaaagactgttgacggccaaaatgaatatgcttttgggcttaaagatggtctgccttggggtcatatcaagcgtgacatgcaaaactttgcaaaacgcactaaagatacaactctcatcatgggagcaaaaactttcatgagttttccagagccacttccaggacgtaagtctattgtggttcaagatatgtctcgtccattagcaactgctaaaaatggatttttcgctgatgcttatgtaagtgagcttgaattcattggattcttaggcggcgatattatggctgcacagacttcctataatagcacaattactttcaatccaggccaagattattctgttattggtggcaaggggattctagagatggctcagccatacgcagaccgtattgtccaaacgtcaatacagaagaaacatcgggttaactctgatgtcactctggacatgagctttattgtattcccttcatggtctaatgatttccaaatggtagaaacctcctgggtacgttgtgatgaactcacttcattgacggagacggtctatgaaagggtataatcttcgtctgctagagacgtacaaaactcaaaagaagtggaaaaactggaacaaagttcacggtgtgtatgagttgtcctttgcaattgaagatatcagagaatatcgcaatgcagagtacactatctatgatagcaatggaaataatccaattgaactttgtcgttcaatgaaatcagtactacttgcttcaatgaatggtaatattagcttttcaaatggctatgttacaatgattggagacttctttaaaagtggaagtcaagtattcttcaatccattggaagaaaaatatgaaaatcaataatcatttgactctgttacaagaagaggcccaaaagaactgggctttggtaattgagggcaatgctcctactattgagcaatataagcgcaagccagagttatacaacacaattcctcatgggttatatcgcattgatgtagaaatcaatgacacttgggcagctgacgaaggcatcagaattgccaaagggttaggtgttaaaattatgatgaacactcgtcaaacaattcatcatatcgctaaaggtaatgtggtcatctctggcaaaatgatgactgtttttggtcgctttgataaacaaggccgtgaaatcttctttcgcccaggaaaataatgaaacaatatcaacagctaattaagcatatcttcgatgaaggttacgtgactgatgaccgtacaggaactggtacttgtgctgtgtttggtactcaattacgttttgatttacaggaaggttttccagcagtgactaccaagaaactagcttggaaggcatgcattgcagaacttctgtggttcctgtctggctcaacaaatgtgaatgatttgcgtcttcgccagcatggttctccgacaaatggtaaaactgtatgggacgacaactatgaaaaccaagctcgctcaatgggttataccgacggtgaacttggaccagtttatggtaagcagtggcgtgactttatgggagttgaccaattaactttgattatcaaccgaattaaagaacttcctaatgaccgccgacaaattgtgactgcctggaaccctctagaactctctaagatggcgcttccaccatgccatatgatatatcagtttaacgtacgcaatgggtttctggacctccagtggtaccagaggtcggtagatgtattccttggtttaccatttaatattgcgtcatatgcagctttaattcacatcgtaactaaaatgactggcttaaaacctggccatttagtatttactggtggcaacactcacatctattcaaatcatattgagcagtgtgaagaaattcttcgtcgagagccaaaagaactctgtaaacttgaaattgattttccgcctgagtttgagcgctggaaaacttcatcccagcttaagtggataaaccgatttgctgttatcgaagacttcaagctagttaactatgaaagtcacccaacaatcaaagggaaaatggctgtatgattactaaatttacaaatgatattggaagtgttgtatatgctcaaactgatgaacagctttgctcatcagatttcaaattgaatagtcatattatgattaaaggctatttctttgtagttgcagggcatcatattgaaattgatggtgattcaactactagaattgttattgtccgtgaagcgtaatgagagcttgtcgagtggttaataaataccattccgatttcgacgttaatatccaacgaggtacaatgtggggtaatgacgttggtaaaaatgctggcagccgtgaggctgccattgaagcctttaaagaggacttcattaagcgtattaggagtggtgaaataaaacgtgagcacttggagactcttcgtggaatgagattaggatgcacttgtaaacctaaagcttgccatggtgatataatagctcatatagtaaacagactattcaaagacacatttacgctagaggatttgcatgaaagtaattaagtccagtggtacctctcaggaatttactccagaaaaacttatcaaagttctggaatgggggtgtgaaaacacccgggttgacccatatgagctatatcaagctatcgttccgcatctgcaagatggaatgacaacttatgacattcaacgcgcagctactaaagttgcagcttcaatgatttcaattgaagaaccagattatcaatatgtagcaagtaatctggcgatgttcaatcttcgtaagcaagtttatggacagtttgagcctcgttcatttattgaccagatttcatttggtgttaatcacaacaaatacgacaaagaaattcttgccaaatggtctgctgaagaaattgctctgcttgaaagtaaaattattcatgaccgtgattttgaaatgacgtatgctggtacgatgcaactcattgaaaaatacctggtcaaagatcgcagcactggtcaaatcatcgaaactcctcaatttgcattcatgctcattggtatgactctgcatcaggatgatggtgaaaaccgtttagtgaacactattcgtttttacgatgctgtgtcaactaagaaaatttctctgcctactcctattatggcaggtgctcgtactcctactcgtcaattcagttcttgtgttgttattgaagctggtgattcactgaagtcaattaacaaatccgctgaatcaattgtagagtacatctctaaacgtgctggtatcggcattaacgcaggtatgattcgtgcagaaggttcaaaaatcggcttcggagaagtcaagcatactggagttattcctttctggaaacacatccaaacagcagttaagtcctgctcccagggtggagttcgcggcggggcggcgacattgtactatccaatctggcacttggaagttgaaaacctcctcgtacttaagaacaacaaaggtgtagatgaaaaccgtattcgtcatttagattatggtgttcaaatcaatgacctgatgtttgaacgtctgattaaagatgattacatcactctgttctctccagatattgatgctggtcgtctttacgagaactatttcaaagatgctgctttattccgtgaacaatatgaagctcttgaaaagaatccagatgttcgtaagaagcgtgtcaaagctcgtgaactgattgagttgttcttaactgaacgctcaggcacagctcgaatttacccttacttcgtagataacgttggtaattatggtccttttattcgtgatgtggctacgattaagcaatcgaacctctgcgcagaaattgcgttacctactaaagacgtctactcagaagacgcagaaattgcgctgtgtactctgtctgcgttcgtgctcggcaacttcgattggcaagaccaagaaactattaacgagctcgcagaagtccaagtccgagcactcgacaacctcttgagttatcaaggttatccagtcaaagaagctctgaaagctcttaaacgtcgagcattgggtgttggtgtaacgaactacgctgcttggttagcagataactttgctacatacgctgatgcaaatgacctgactcatgaactgtttgaaaggctgcaatatgcactcatcaaagcatcaattaaacttgcaaaagaaaaaggaccttgcgagtattataaagacactcgttggtctcgaggcgaattacctatcgactggtacaataagagaattgaccagctcgcggccccgaattacgtttgtgactgggaagcactccgtgcagaactcaagcaatatggcatccgtaacagtacattgtccgcactcatgccatgtgagtcctcctcccaggtttccaacagcacaaacggtattgagccgccacgaggtccagtttctattaaagagtctaaagaaggaagcttcaaccaagtagttccgaatgttgaactgaatgctgacctctatgattatgcatggaaacttgctaaacagggtaacaaaccttatctgactcaagtagctattatgttgaagtgggtatgccaatctgcatcagctaatacttactatgaccctcagaactatgagaaaggtaaagtgccaatgtctgttatgatggacgacttgctttacttctggtactttggtggtaagacgttgtactatcataacactcgcgacggttctggtaacgacgattttgaaatcgaaaaaccaaaagccgaagattgttccgcatgtaagctttaattctttcagtttataattggaccacggatggtccttaggaggatttatgaagcaaactatgagtattcaagaacttttggaaatagttaaaacaatagagttgacgcctgaattcattgaaaaattaagaaaacgtcttaaaaagctagacgaagagtttagaatttattcagaatcaactaaagttacatcagaattacttaataggacatacaatttatgagccacagaacagaagcaaaatggtacgacatttatgccgtttataataatggcgaacaaatgaaaacattcatcattcgttctgcattaaacgaagttccacctttaatggtaaacgacgacgatcacagtcttgcaatgtttcttgaaggttatcgttgcgcagctgaagctattgctcaggtgaatgttgaatttgaatttgaggaagttaaatgagcacagtttttaatacgcaacaagtagatttgatgaccgagccgatgttcttcggaagtgggcttggtattgcacgatatgatattcagcgtcaccgtacatttgaagaattgattgagaaacaactctcattcttctggcgtcctgaagaagttaacctgatgactgaccgagctcaatttgaaaagcttcctgttggtcaacagaatgtattccttgataacctgaaatatcaaagtcttctggattcaattcaaggtcgagctcctgcagctgttctctccgctttgatttctgacccgtcacttgatacatggaaccagacttggacgttctctgaaacgattcactctcgttcatatacgcacatcatgcgtaacttgctgaatgacccggcgaaggtgtttgatgagattgttcttgacgaagcaatcatgaaacgagctgagacaattggccattactacgatgatgtaatccagaagactcgtctttgggaaaatgctaaagaagaggttgatttttataaaagacagggtgatgattatgattcgttctgttctgcagaacagacagaatattacgctaagcgtgaattgatgaaagcactttatctgtgcctgcacgtcatcaatggtcttgaagcaattcgtttttatgtatctttcgcatgtaccttcaacttccataagaacatggaaatcatggaaggcaactccaagattatgaagttcattgcacgtgatgaacagcttcatctgaaaggcacgcagtacattattcgtcagcttcagcttggtactgatggcgaagaatgggttcagattgctcgtgaatgtgaacaggaagcagttgatatcttcatggaaatcaaccgccaagaaaaagaatgggcagttcatctgtggcgtgatggtggagttcctggtctttcagtgaaaatccttcatgacttcatcgactatctgaccgtttcacgtatgcgtagctgtggtcttccatgcccgattactgacgctcctgttcgtcacccaatcccatggattcgtgaatacttaaactcagatgcggtacaatctgctccacaggaagttgaaatttcttcttacctggtagctcagattgacaacgatgtcgatgctgatgtgctgttgaaattcagaaagtatttgtaaggagagggccttcgggcccttctgttatgaaagatattgctaacgagttttcttttatagaatacactcaactgaagctgctacctgattgcactatagaccaagtccaagttccaaacaagttgaacgtggtatatgcaattgcagttgatgatgagttggtctacatcggtaagaccaagaatctcagaaagagaataaattattacaggacagcgattaatcgcaaagaccagacatcagattcaactaaatcagcaaagatttacgatgctctgatgtcaggaaagactgttagcttctatgctcgacagtgctttaatctcctgataaacaatgaactcggtgaaatgtcaatctcaacgatggaccttgaggagccgcttttcataaagaaattaaatccgccttggaatacacaacataagacaaaatgaactacatcaatgtgtacgatagttttatatcaagaggccgtactcgcggcctcgataaagcaaaaatcgattactacacggagtctcaccatgtagtacctaaatcactgggaggaagtgatgacgatagtaatctggttttactaactgctagagagcattttatagctcatctattgttatcaaaaatacacaacaatagcaaaatgcactatgccctttggatgatgtgcaattatgctgataaaacttttaaagttcattcaaaattctatgaacgagcaagaatgaaccactctgaatcagtgtcaaaatcgctcacagggaggaaacgttccgataagcacagaattaatttatctaatgctttaaagggaagacagagccataccaaaggaaaatgtcttaaggatgaaacccgcagaaagatagcaaagtctttaacaggcaaaacgcagtcagaagaaaccaggcgtaaacgttctgagtctcaaaagggtaaaagtaaagcactatacccggcttgtccacattgtggtataatatcttccaaagctactgctatcagatggcactatgataattgcaaatttaataagggtaaaaagtgaaaaaattattcaatgagctcatgactctatgtaacgatgaaactcgtttcttctaccgtgatgatgtatctccaatggggtacaaataccgcacgttttcttaccattacgcatcttactctgactggcttctgccgtctgcattagagtgccgtggcatcatgtttgaacttgatgttgatgacatcccagtgcgtattgcatctcgtccaatggaaaagttcttcaacctgaatgaaactccgttcacgatgaacttggacctttccaaagttaagtacatgctggctaaagaagatggttctttggtttctacttatctggacggcgaaaatcgtattcgctttaagtctaagacttctatcaaatctgagcaagctgttgaagcttctgcaatgctggcaagtattgagcatttggatttggctgaagctctgattgatttagcaaaagatggcttcaccgctaacttcgaatactgctctccacagaaccgaattgttctgagttatcctaaaaagatgcttgttcttctgaacgttcgtgaaaacgataccggtgagtatgttgactacgaagaccttctggctcatccagttcttcgtaagtatctggtagaagcctttgaagttcctaaaggtgattttgtttccaagcttcgagctgaagagcaaatcgaaggttacgtgatggttatggaagatggtttacgctttaagctgaaaaccgaatggtacacggctctgcatcacaccaaagactccattatcaacaacgagcgtctgtttgagtgcatcgtgaataacgcggcagatgaccttcgtggtatgttcgattctgacgagtttgcattgggtaaaatcaatgctttcgaaactcagtacttgaactatctgcgttcttctcttaagctgtgccaggacttctatgctactcatcgtggtaaagaccgtaagtcttatgcagcaaacgctcaagctgaaaccgcattggccggtctgcctcaagttttcggtatcatcatgaaaatgtacgcaggagaccttgatgacgaccagctcatcaccaagctgaactgtgcattcttgaagaacacaaagccgttcactccggctgagtacatctaaccgtttacatctccatttggttgtgttactatgtctctacactaaccaaatggagaaaacgaaatgctgaacttaatcactgccgaagagctagtagaaatttacgaaggtacacaccatgacgggattcgtattttcaaaaattctcgtcctctgggttacatcaccgatttacgtgtagcttactctcgcgaccaaaagcgtcaaaaggctcgtaaagaatacagcaatcgggtaaatgaagaacgtgctgagaagatgcctgaagcagtagaagaaatgcgcagcttcttagataatcatctgaccaagtacggcgcagaagtgatgattaacatttcccaaccaaacgttcatgtaaatggttgtaagtgctacatcatcgtagacccaatctatggaaagcatcgtctgggtgtttctaatcctcgtctgtctgcttcagaaatggcagagatggtggacccttgcttcaaaattcaaaactctcctgctgaacatcatattcttatcaatggtctttctcaggacgatattgtacaggcaatcatcaaattatgttcaaaataacaaacatccacgtcattttagtggcgctcggattaacagcttatgggttcattcaatatcaatcttcacggattgatagcttaaaagaagaccttaagcaaatgcaacaaatagctgaagctaatggcaaagctattgaaaagttaaaaacagactttgtgaatctcaataagtatgatgagactcgtaaagaaaacagagcggaggctgataaatccgatgctaaaatggctaaagatgctaaacgcgagcatgtggtcaaagctaagcctaagctggttgaaaagcagttaaatgagtctttcaacaaattgactctagagttccaggaggccaccaagtgaaactcttagtagccactgtattatcaattggactattggctggatgttcccagaagacaccagaattaccccagccaactgtagtgcatccatcttggcctgaccaaattaaaccttggaacgggcattggactatcgttgaagttgatggtcgtccatttgtaggaatgccttattctgattctcaggagtttagaatttggttaaatgatgttcttcgttataccaaagatgctaatggtatgatatgttactatcgctccgaattaaaggaaccaaaatgcgtaaattcacgttaggtgcaaagctgttttgtttcggtctgttcatcgctgcagttgcatgttccgtagctcttgcaatggtagttacgttttaattgaggccttcgggcctcatcgggataataaactttgaggaaaatattatgcgttactttgtaaaagatggttcattcttatctgcaattaaaaagacccagttacgcaaattgtgtatgcagggcgcccgtcacaaaactccattgatgcgtaaagctactgtgagtccctggtttgaaattattggtggaaagcctactgtagtttctgtgagagtattcgctcctggaactgaaactattccatctcatgtctttaagctcaaagaacaaacttatatttcagaagaaacttggttcaaaatatttgctcctgttgaagattacgatgaatggtatggcattcgcatggaagaagactataaacgtgatttgattgacaagcttattgaagcagcttcaatttacgggcaaattaaatccaattgtgcaaacggatttatttcggatgtcgagggttcaatgcgaccagcaggtaaagatgttcgtgatattcgtaaatcattatatgaggcacttggactatgaacaaatttgctaaaatggctcttgaaggcgctatctctgaacttaaggctcgcgcaattgactatggttcagctaaaactcgtatgcaaatggaagacggttatttgacttacgaagaccttgttgtagaaacaatgcaagctaaagctcgatacgatgaagctactgcgcgtgtaaacgtcattattgaggaaattgctaatgtccattaaaattctactcgaaaaataccgcaaagcttcatatgcttattcgtatggacttcgtgtagatgatggttcagttcgcgcagaacaagaacttgaaaacatcgccatagacttagacgaagctggagcaaatttacgacgtgccgtaaaagctaaagcgccagaactagcaaatgttatgtcaaatttaatgactacacagctatttgctcagggttcatatttgtctgctttgcttaaaggccgtaaagaagaatggttagctaaaactctagctgattataataaagctaaggctgatgttgataacttcgtaaaggaacttgaatgaaaaagattattttgactcgtggtgcaccaggttgtggaaagtcaacttgggcaaatgaatatgttgctaaaaatcctggttggtacatcttgtcacgtgacgacttccgtgaaaagctgtttggtcttgatgctcgtaatgcttacaaatattccaaacataaagaacgtgctgtaacagctgctcaaatttctgcagcagtgtctctgcttgatttggaacataccaaaggtattatcgtttgcgatactaacctgaaccctaaaacggttgagaaatgggaactccgtttcaaaggtctttatgaaatgtcttttcaggatttccatgttccttggactgaactggttaagcgtaaccaatatcgcggtgataaagcagtccctattgatgttctgcgccatttctatacgatgatggaagtcgagaatgtttatgttcctgatgcttcaaaaccaaaagcaattatttttgatgtcgacggtacattggctaaaatggtagaccgtagtccatatgacctcgagaaatgtgatactgacgtaatcaatccgatggttgttgaacttgctcgttcttactatcgtgacggttatgctattatcgttgtttctgggcgtgaatcaggaaacaaagatgatgaaatcaaatacaaaatgatgactcgtaaatggctcactgataagttcattccatttacagaacatttccagcgggaacaaggtgattctcgcaaagatgacattgtaaaggaagaaatcttctggcgtgatattgctcctcattacaatgttaaactggcggttgatgaccgagcacaagtagttgaaatgtggcgtcgtattggcgttgaatgctggcaagttgctcatggagatttctaatgggttatcatgaatgttgggctatcattaatagtagcactggttgtgtagttatatttgataatcattattgcgtatatggtgaagaaggtgctgcttgggaaacatgcttaaaagttcgagcagctaatcctgagagaagttatacagtgaagaaaaccaaactcatgcttccatggcatcgtcgataatgcataaggtgaaatgatgtataataaacatgaagagattaaagaggaagcttacaagcttcttcgtgaaatcgtcggtatgaatatgactcccgagcttatcaataagcttgctcagattcgcactgatatgaactctcgatacaaagatgagtattatgtagagttcgttccaattggtgaggttgttactcactttgtcgttaacgttaaagtacacacggtgcactaatgggaattcatactacagtaagtccaggtctttcaagttttcgtaaagtagctgaagtcgttgtagctcaggttgcagataattatctgtttactccaaatacagctccaacacatgctcagattcatgctgatatcgtaggtgctttacaaattctttggaagggtattgagtttaaaatgactccatctttcaatagctttacaatgtcatttgatttccgtttagatattgataaagatgaccctattttcttctctgtaatttatagctgggacaacagtgacttctgataaaacttttagacgaactgaattttgggaaaagattaaagaattcgcgcaggctttagcagataaagtacccggagctgaggttcagctccgtcatgctcgcattcctaatggagctttaatcacaatcactcataacggaaaagaccaaacatctttgctgactcttggccgttatggacatgttacaatgactaacgtattaggtgatataatttgatgaatttaactgacatcttcgatggtgtccgaaaagaacattacaacgcgtgtggtgataaatctcaattcactgaagatggtgttggattcattcgttctgtgttagcgtgtgaccgtctggtgaattcttgcgtagggtatgatggaatccttatcacttcaaaagaccagacttctcctgtcgtaggtgaacgtttttatggcgatgttttctttgacaaaaagaaacgctttaaagatggggtgtttataatcactagtacggtacaagagattattactcttcacactgaaatcacgctgattaaaactgaccgttcaaactatttggtgattcaataatgaaagctagcaccgtcttacaaatcgcttatctgatttcccaagaatcgaaatgctgctcctggaaagtcggtgcagttattgagaaaaatggtcgtatcatttctaccggctataatggttctcctgccggtggagttaactgttgcgaccacgctgaagataaagggtggttagttaagaaacctggaagcggtcttcgtcaagatggaccaattccaaaatatggattagacactaaattccgagctgaacattctgagtggtcgaaaattaacgaaatacatgctgaattgaatgctattctgttcgcagcacgtaatggttcttcaattgaaggcgctacgatgtacgttacactttcaccatgcccagactgtgctaaagctattgctcaatctggaattaagaaactcgtatattgtgaaacatacgataaaaacatcgatggttgggataacatcctccgcgatgctggtattgagattcatcatgttcctaagacgaacctgaataaactcaattggtataatgttgaaaactactgcggtgttgaaaatgcttgatttgaataaaaccaagattactgctgaaccggaagatatcactggatatgtagcacaacgtctgcgtgacttggaaatctacaccgttgaaattcctggcccaacgttccaactggaacaagccaacggagcttcttgcttcgaggttgtatctaagattgccgatgatttggattatgctatcgcagcaatcaacgagtacaatccaattgttgtatttttacgagaagtaacaaaagaaccgagcggtaagtacaaattccgcttccaatatcttgctgaatataaaggccaaactgatgactaagaaaactaaactgactgaagctgaaaaagtacaaatccgtgatactctgaaaccaattctggctcgtggcgaatcccaggtagtatttgagaaagtagacggtactatccgctctctgcgttgtactcgcgaccatgacatcattccaagtgacttggttgaaagcactggctctcaggtgtctcgcaaagaatctacagaagctattcctgtgtgggacactgaaaaacacgcatggcgttcattcaaactggattctatcgtttcagtgaatggtgttaaagtagagcatctgctgaaactggttcaggttaaaggttaattgcttaaatatgagcatgataatattatttcatgctcaaacaacaaggtgtaacaatggatttaccaattaaagctatcggcgaacatgttatcttggtttctgaaccgcctcagcaaggtgatgaaatcgtttcttctggcggtattgttatcggcaaacaagaaaccggacaaatccctgatatgtgtgaaatatattcaatcggcgcggatgttcctgaaggtattttcgaagtcggtatgttagtgccgctgccaactggtcagattcgtaatgtacctcatccgcttgtcgctgctggtatgaaaaaaccaaaagaaattgcacaaaaatttgtgacttgtcattggaaatcaattccgtgtatctacgggtgatataaatattattgtaatttggctgccggacaaaagttaaccggagaaattacaaggtggtagacgcagtttaaattctgataccgtctaccttttattaacctcgtattgaggaatgacataatgtcaatgaacaaacaacttgaacacgctctgcatctgcagcgcaactcctggaacgcaggtcatgaaaactacggtgcatctatcgacgtttacgccgaagcactggaagttctgaaaggtttcaaacatctgaatcctgttcaggcagacctccgcgatgcacttgctctgaaagatgagttgaagtttgctaaacctctgtgttcagcagctcgtaaagcggttcgtcacttcgtagtgactttgaaataagtacccttcgaggacttggtcgtggttggtagttagccagacgttaaatatccaaaacttccattaacaacggctctacgcgtcagcaaaaggttagctgtctaagacgtagagctcttttattacctccttatatggaagactaaaaatggctaaacaagctaaagcaaaaactgcagtaaaagaagttgttggtacctctaaacgcgctggctacaagcgtggttcgaacaagcgtatcaatcagctaacagataagttagcatctcgtgctcgtaaagttattgctcacgacacggcttttggtaatccacgtaagaaagcataaagcataagttcgggactccttcgggagtcccttttttgtttaagaggttcatatgtttaagcgtaaatttatttttaaagttacatcagaatacccggcagaatattcacatatggattcaatctttttctatgaaaaggttgctacgctttggccatgggaagaccaagttaaagtcggaaactcaatgctagaatcattgccgtcatttggtatttggacagatactgaatatcatagttgcgaaaaactctaaccgtttacatctgttgaaagttgtgttatgatagaatctcaataaccaatatggtaacggagaataaaatgaacacaattaatctgaacgctaaaatcaaaactaaagaccatgacggatataaagcaattgaagtagaagagccaatgtggcatctgtcttcatggcaaggagatgtagttcactgtatgactcctgatggtccatctactgatttctgctggtacatcgttttgactaactggttcactggctctgaatacgttttgaaaacaagcattcacggtcacattcgttcagaaacttatgaagacgaagatggttattctgaagatgtagtgtggtatgaaaatggacgcactcgcgcagataacttgattgagaaaatgaagaaaactggaacagttaatcttgataactggaccgaacgtaaaatgttctaggccttcgggccttatgaggaaactatgaaaagtgatgttctgtaccgcttagaaaaagaaggctttttaaaatccgctgaaggctgtaatcagagagtgaatcagcttattgctgagtatatcggtgacagacctttttacattgcaaagggtgaagcaattgcttcaggttctattggtcttatccgatttgaaaatgaaggctggataagtccaaagggtgctgatattgatggtatgaatggcgattcatgtccttggtttacttcaaatgaagttaaaaattttctggttgaaactgaagaaaagaccgttgaagtgatgtatgcggcttttggccagactaagaaagaaaacgtttggttgaatctggaccaagtaggggaagcgcgttccatagctacgcttatgacgtccgaagaagctcatgatgcatgcaagtcgttcttgcgtaaaaacattgaaggtaaagctgccattatgaagatgattgcaactgccaaaaccgagcaagttcctcaaacaattttcacagaagtgaactaaaccgtttacatcctccgttgtatgtgttagtatataaactcaataaacaaacagatacaacggagaacaaaatggattacactaacttcaaaaagaaatacgttcaagataatgcatgggacgtttcaactactttactctgggaacataaaaatggcacagttgctcaaatcgatatgtactgggaagataactacgtcttcatcagttttgaaaatggcccaacattagacgttaaacttaaaggttcagtcatttctgttggtttccatgatgaccatcgtaaacgcgatttaggaactcatccgtcttggaatggtgataatcgtaaaattttggttaaactttatctgcgtcatgttcttggtcagaaaacaactgaagaacaacgtgaagcaatttgggatatcgtttcaaacgaattcgtaatctaaatttagggccttcgggcccttcacttgaggaaatatttatgagtataattggaaaaactttcaagttaactggaactgctatcaaagattatgcttctcgtcagtcgtgctttggtgatgcaattcttaaacttactgacaacggaaaaattccgttcgttgtaaaatctcttgataaagacggttgcataacagctattgatattaacggttctcttcatcagtctggattgggttcatttgacacagtatggtgtatcattatgtctcaagagatttcacggtaccttgaagaagttaaaccaacagagtctgatgcaaaagatttctggatgatgactattccaactaatcgctcgcaacagcctttctgtgttggtccttacactgaagaggaagctaacgaaaaagctcaaaagcaaattcgtaatgcagttgaaggtgttcgtgttctggttgttaaacaagttgctgaagctaaagttaaaactgtattggagactctgtaatgattatcactattcctcgtaataaagcacctgaatttgaacgcggcatgttgagcaatccaatgattgaagtgctgggcgtaactgtctctgatacagaagtcaagtatcagcttgaatgccctgatttctttcatcaaattccaacttatgcggtggcagaatgaaataccacattttacaacccgtacagctgcgcaaaggcggtattccgggagtcatctgtgatactgctgaatcaattcaagaatatggggttcaacccgcttatgaagtacaatgggttgacgggaatactgatattcgtttagaatgtgaaatcgaacctcttaaagctgctaatgacgaagtttatgaaacagtttaatgtaagagggttaacgaaggaccttctggaatacgcaagaacattagccatatgtatatacagaattggtccttcaagtcagcctgggttcatagagataactctaagtggcccagctaacagtatcgcaacctttgagaaaatgttatgcaagtcaaatatgatatgaaaggtcttgatgttttaaaacgcttaaatcaaggcggtattaaagtaggagagttaactactctattaagtggagttggacaaccatcactgccgggtaaatcttgtatcgcggcttacatgattgctaaaatgaaggctaaaaatgtcaaataaaccaattatctctactgatgtagatggtgtattagtaaagtggcaatcaggcttgccttacttcgctcagaagtacaatctgcctgttcaccatattcttgaaatgattattgatgaccaattcgttgcgccaaaagatctgtttggtgtagacgaagaatttgctcaacagctgatggtcaaatataattgctcagatttcattcgctatctggcagcatacgacgatgctttgaaagttgtcaatgctcttaaagataagtatgacttcgttgcagttactgcgcttggtacttctgttgatgctaaactgaatcgtcaattcaacttgaatgctttgttcccaggtgctttccttgaaactttcatctgtgaccacgctgagccaaagactaaactctttgagaaaatcaaagagaagtacggtgaccgagttgttgcttatattgatgaccttcctcaccatgtagattcagcttatgaagtctttggtggtgatgttaattgcatgttcatgcctcgtggtcagcgagacacctcctctaaatatggagaaaaggtgcataactgggaacatgttcagcggctgatgaatcagcgtgaattccaggaaagtcttggtgataagctgcaaaagattcaaaaaggtaagctggaagaagttccatatagctggcctccaattgaagaaatgtttccaaagaaatgggtaaacccaggtccttctgattataagccatggtatgagcatccaggaaatcttcctgtgcatcgtccaaactttggaattgggacaggtatcgaatatctgaatcgtcagcctacagctaaaactactataggtaaagcatgattaacgtaattgaatggttcccgcaaactgacaaaactaggcgtttagaaagtttcgcaaacaaagaagagttcttcaaggcgcgtaacattcatgctgataatcaaaaacaacgtgaaatgattgatgcaatgttcaatggcgcaatctacattactcgtaaaaatggtggagtactttaccaccgaactttggctgaactcattcgtgagtatcgtggtcaatagctttacaaagggtatgnnatataattgtcatacccgctcgggacaataaacgaggtgaatatgattttagatattatcaatgaaattgcttcaattggctctaccaaagaaaaagaagctatcatccgtcgtcataaagataatgagcttctgaagcgagtattcagaatgacttatgatggcaagctccagtattacatcaagaagtgggatacgagacctaaaggtgatattcatcttactcttgaagacatgctttatttgttagaagaaaaattagctaagcgagttgtgaccggtaatgccgcaaaggaaaaacttgaaattgctttatctcaaacatctgatgcagatgcagaagttgttaagaaagttctgcttcgtgatttgcgctgtggcgcatcccgtagtattgcgaataaagtatggaaaaatctaattcccgaacagccacagatgcttgcttcatcttatgatgaaaaaggtattgaaaagaacattaagttccctgcatttgcacagcttaaggctgatggtgcccgagcatttgctgaagttcgtggcgatgaattagatgatgtaaaaattctgtcccgagcgggtaacgagtatcttggtcttgatttgttaaaacaacaactcattgaaatgaccaaagaagctcgtgaacgccatcctggcggtgtaatgattgatggtgaactcgtctatcatgcaagcactctcccagctggtccattagacgatatcttcggtgatttacccgagctgagtaaagctaaggaattcaaagaagaatcccgtacaatgtcaaacgggttggctaacaaatctctgaaaggaactatctcagctaaagaagctgctggtatgaaattccaagtatgggattacgttccgttggatgttgtttattccgaaggtaagcaatctggatttgcttatgatgttcgcttccgtgcattagaactgatggttcaaggttactctcagatgattctgattgagaaccacatcgttcataatcttgatgaagctaaggtcatttatcgcaaatacgttgatgaaggtcttgaaggtattatcctgaagaacattggggctttctgggaaaacacccgttctaaaaacctttataagttcaaagaagttattacgattgaccttcgtattgttgatatctatgagcatagcaagcagccaggtaaagccggtggtttttatcttgaatccgaatgtggtctgattaaagttaaagctggttcaggtcttaaagacaaaccaggtaaagatgctcatgagttagaccgaactcgaatttgggaaaacaagaatgactacatcggtggtgttcttgaatccgaatgtaatggttggttagctgctgaagggcgaactgattatgtcaagctgttcttgcctattgcgattaaaatgcgtcgtgataaagatgtagcaaatacgtttgctgatatctggggtgatttccatgaggtaactggtctatgaaattctatttagaaattatcacaattgctcatccaggtgaaggctcaggacgagccgctaatgtaacacagagtttggtcgaattaccattccgtccacagggtgaagtggaatcatttacagatggtcgagtttccggaattaacaagcatgaggtcattgctacccgtggcggtggaaaggttgaaatcttccggaatattattgcagtctaagcccttcggggctttagttgtctataaatataagaaacaatagaggactcataatgaccgaatttcaattaaatgaggtttttgatgcggattcagaaatgcttccggtcactaatctttatccgaaaactaaaattccacagatttttgctattgctgctccggaaggttcagtagctcttcgtatgtgttcttacaccggtggtggagacgttaacaagaacgttaagcctggtgataaaatgatgcatgctattgtacttggtgtatctgaaaaaggcactttggttaagctgaaaaatcttggtggcaatccattgggtgttatttctaccatgtttgacttagtatctcaaactgtgaagaaatacaaaatggatgctgtaatgtttcgcatcaataagtctaagatgggtggacaagctcgagcagtgcagatgattatcaaccgtttggtgatgagtcgtctgggtggtcgttttgttatcctgaaagaactctatgattacgataagaagtacgtatatgttcttattcatcgtaagaatgttgacctctcaaccatccctggcatcccagagatatcaacagaagagttcactaaggttgacactgcggtcggtgatgtttacatcaacaataagtcaggtaagcaagtttctaaatcggaagcgttagcagctactattgctcaagagaatgacaaacgtactgaccaatctgttattgctcgtgctaaggtatctcgtcgtcaagtagcagcaagtcagtctttaacttctgacattattcatgacccagaagaatttgaaaaatacgaagccactgctgctgaattcagtaaaccagctacagcaaatcctattccggaagctcagcagttaaaggacgcggtagaatctaaagcggctaaagctcgttctgctcaattggcagctactggagctatattccatttgaaatcactgactacaattaaattaagtcagtcagaaaaatttgaagctagatttgttaaagaacttgaatcaagaattggtaatgctccattaacttcagttcagagtatgcaagcatatactcaaactcttttagacacattagaagagcgtaaatatgaagcaatggaacatatcatgactaaagttccacaataccttgaaccaaaagataaagagcaaatggctaacaatctttggaacattgaacgtaccaaaatgattaaagctgctcttcaaggttatgctaaaaacgtttctgctactatcgaagatattactcgtactcgtacacctcttcaatatacaaatgcagaaaaacgcggcatcaaagagtatgttggttccggctattcagacatcaacaatatgcttttaggccgttatagagctgacaattacgatacgctgtcttataaagaagttactactgctatcaaaaatctggatgatgcttttaaacgcggtgacagaattccagaaggacttaccttatggcgttctcagtcagtccgtaagccaatttttgaagctatggttaagaacagagtgttctatttcagaaactatgtttcaacctctttatctccaattatttttggcggttggaaaggtaaccaagcagttgcaatggcttctgataatactcgtgcagtattgaatcagccagataacagtgcagaaactgtcaagttagcttctatgacttatgctgaattaggtcttactgatgaggttcatgcagctaaagacgttcagcaggcggaaagcacgagagtcatgattggctgggctattactggcggcgagaaagttaacgttgtttatcctggtgacctgagcaacatgtctggtgaaatggaagttattctgcctcgcggtactatgctgaaagtcaacaacattgtagatgcttcttatagtgatggtctagtgtatgacaatcagaaattcatccaaggcgaagtaatgacagctgaccagttagacgaagctgttgtttatgatggtgacgttctgatggaaaccggtgaagtagtagaatacagtgacgaacctcagcctgaaccaagtccatatgattttgaaggatttgttaagtccacaaaggcatcagaaagcaacaagattcttgctctgttggcttcaatgattgatgttgaagatactccagagaagttcgttctttaaccgtttacacgcacatggaagtgtgttactatagacttacactaactgaggagaacatcatgaaatcgattctgcgtatgaatggccaagaaactgtcgttgaaggtgtagttccagtatctgacgaattcaataacatggtctttaacgagattcaaaagattgctaaaggaatggttgaaatggttccactggcacctttcggaattccagaagacaaatgtgaggggtatatcgcttacactctgaacggtaagttcaatggtgaagttccgtttaaaatcactgtaactaacattgagcaatcttcggaagttgttctgaatgctttcgtggtgttccgcaaataaaacaaagggagccttgcggctccctttttctatagtccaagtatcttggaagtactattccacattccagtcttacgccctatcgcattacccatctgagtaatacctccagcagcgcctcctaatctactaagtcttgacagtgatgagtccagacccatgtcatcagaaatatttccaatagcatgaacaagtctatcttcaacccagtcagcagcagcttgacgaccaacagcacctacctgcataacacgataagcaaactgaacgtcaaatacagcaatttggttgtcaccatcccaagtaaattcaggtgaaccacatgaaactggaacacaacctgtgaacatacacactgtatgaggtagtccattgcgtgcatgcaagttaacttgaatatcagcttcaacgtcaacaggaagagctcttaatccagtgacagggtcttgtacagagttaacccagtcttgcattgctctccagttacttgcttcagaatccattcggaaacttaaagtaagcggctctaattctcttccggtgatacgaatattcggagagttatgaagccagtctgtttcatgagacagtctattatcaggaattttagctgaataaatcatcaatcctgatgttgggaaagccatattgaagaagtcaagtaaataagtaccgacttcaaattctcccaataaagactgaacgacgcggttagtcattgcgccaataaggtacttagatacgcccgatttacgaacaagttcctgagtacctgcggtgataattgatgtaagtccttgtgtaaattcgccttgagataatccaagccagtctcctgagactggcaagttattataaagcattccaccgaattggtccaacagtaattgagactttgcagatggagacgttgcgaatacacaactaaacatatttgtacgttggaaatcaacgttcattacttggttgttgaattcatctaaattaagcattagaaaccttctgcataaagtgatgctctgttcaatgtcaagatttcacggaaagtaatttccagagtaaatgtgcttggcatattaggagcaattgctaaaccattgaattgaccattcggagttttatcgaagcgaatactctgaatctgacacggaccaaatacttcagctcttccatcaaatttagatgtcttaccaaagtttcttatgaaccataccgttgggttagtcacaacaataacgttacttaagaatgaagtgatattttcaaacatcgtgttattcaaatcagctccatctggagtcaatggagataacagagttgttttgtaccactcatctaattgtcctttcaactctttagcataagttgaattaccagtttcaccgtagctgaaatagttgaagtactcgtatatttgaataattgaaatcaaatccgccactgaacgaggagtcaaatcccaagtgaatactttcgttctgttatctgcgcccgcatacatgcttcgtgcagtgttatagatttgctcgttattgtcagccatcagaccttgagtgattgaatctaatgcaccaaatactgctgtagatgcaacgttactcaatactccagtagctgaattattaccacgagtcattaatgaatcaccaacatcattgaacttatgagaagttgattcaacgtctgatttagaacgtggaagtaaaatattcgcaatcggagatttatctacttgcccgttgtttttaattccaagactattgagaatagaactcgctgatttactcaattgcgattgacgcatactacgaaggtcaggagtcgttcttgaactcatatcgtatgcagtaaacagcaatccgttcttataaaggtcatgaacgcgaaggtctcctgcagcgtcgttaccggcagaacgttctgccggatattgagctgttacagtacttcttcgagttgatgaaatagagctttgaccggcagaggtcttttctccactgccgaaagctttatctagaatttctgtagctcttatagccatgattattccttagttaacaccagttgcaccaaatacgcctggagcattagtgctcgttacaggactaacagtatttatagttctactgttgttaatgacgttgtttgtattgaacaagttagctgcagcagctcctgcgccagttcctaatgaagctttttcagctgctttattcttctcgatactttcgacttttttaacatcttcagattgagatgatggagcaggctgtggttctttgcctttgagcttatcatacttagcagtaacaatattcatacgagcatttaattcttttttggtaataggagaattattcaggtcagtgtcatttaactgtgtctgaagattagcgtatgctttatcagctgattgaactgaacgtttatcgtcaggattgatttgttccatgtatttttcaaatctgacaatagcagcacgagcttcattacctttcttcagaacttgttccctttcttcaggcttcatctgacggagtttttcgttctgggctgttctttcttcgtctgtaacaaaatcagaaatgttagcatctccagttattttgttaacaatccaagttttaccttgagatactttatcgaagaagttttcacctttttcaatcttagatgattgatacttagctaatgtatcttggtcttctttagaaagagagttacctgttctttcttggaaaccttctaatgcagctccttcaacagataatgcagcatctcctaaaccaggaataagtgaaagaatagcagcagctacttttgacattcctaaagaaatgagttcactgaggttgtaaatgatttcagttacgccttttacaatagcaacagtcaatccagaccagtctccagcttcccagaacttctgaatgttttcaagtgttccgaatatagatgataatgtgcttccccattcgccagcttcagcagagaacttatcaaagtctgaagtgaatttgtctgaccaatatttgaagtgcttcattatgacatcgataccgagcacaatagagaacaacagtgcagctgttttagcagcttcaatcacagcagttaccgtgtacttgaaaagcattccagctattctatccgtgatactcattgaagccttaaatccgctttttgtagctttaagcagattactcagagtgtcagagtctttcttcttacgttcctcatcagctccctttttagaatcactctctgggttctctggaacggtagggaagaacgcatcattagggttattggtattattgacagggtcaggaattaactcctgaagtaactctggtaaccctggcgtcactatatcaacaggtactgcatcttcaactacagatagagatgtatcgggaacagatatctgcggaagatttggagtgatagctgaaagacgttcatttaaaagttcagtcagcttactgagcttatctgaaatcttgtttgacacttcggtctgttgcttaacagcttccgtggttctttcagatgcttcggcagttaattcagccccagcagtagtatcaattatgctttggtcaactcgattcaaggcatcaataacttgattacctttatcctcaattacttcagacgtaagctcagcttgagtttgtaaatcatcaagctgtgaagaaagaactgataaagattcggactgagttgatgcagctttcgctgcatctctttcactacgaccctcttcaataaccttccgacgcatagtcttcatgttttcggttttcattcaaaaattcctatgattttggcaactcctctgatgtcgccattagggccgcttactgctacggtacttgaaatgtcatctgcccatttggtcacaaatgctggcatcttcatgaagtcgacatcttcttttttaccgtctaccgtctcaaggcattttgaaagcatcttatcaacaccgccaaatccttcaaactgctcaggagctctgaatttgaaagtatgaccagcgaattgaaattctaatcgttgaacaattcttaaagttgaaaggtcatattcaaaatcgtctttgactaccttacttttaatcttaccgttgaactcaagtaaatgaattgaaacgtaatcgatttcggctggtgttaaacccggatgaattgaattaatcagcagtgataaattctcttccggggatttaacttctttcagcatgttgtgatgcttcaatccaagcttaggaatttttatttccttctggttcacttgaattgttttcattggaagtatcaggtttaaattcatttttcaccttaattggttctactggacttaagttctgtccgttagtaaacatatacaatgtagttattgactggttgttagaaacttcatgaataacttcatctacgtaaaagtttgtgcggaattggtttttagggtcaaagaagtttatcttttgacctggagtatattcaaaattaccaaccatcgtgcacttagcataaccatcatattgtgccattgttcctaatcgcagagcttcttcgtatgcgttacgataagtcatttcagaatatgaacctgaacgagacactaacaccgagttataaccatcgcccgtaacaattcgagggaattgattatccaagaagctgtgagcataaaatgtagcgttagccattgggtttcgggtaaattggttagctttagtgagccactcaaaattataagcaaggtcagtgtttaattcattaaccatttgaccgatttgacgaggttcaccaacaacaacaggaataggctcttgggcaatcatgaatgcataatccatcatgttaatgccatagatgtcttcccacacaaatacgaattggtcactttcaactgccagagatatttctctaacccaagctaaatagtcctttaacgtactcgtccatggaactcgtggaacgtaggtgttaatcgagtttatagctggagcaatatgaggagtgtcttggtaaattacaccaatcatctctttaattgactcaccagcatcgttgaagaagcaacgactaaacttgaggttgataatctcgtgcaccaatccaagttgaattgcgatgatgttatcgcctttagagtcaactgaaactgaaaaatgcttacaaccgtaaatacggttcaatgttcttttactgtttgcattggccacagaaatctgaatgatttggtcaccattcattctggtatgcatatttttgttatcataaaattgcagcataccttcatttctgccataaagaccatcacgcatagtgagtgtcgttacagttgctgctaattcaaggaaacggttatctaaccaagcatcgtaattttcatagagctttatgcttaagttaggaaaacctggacgttgtagtactgtcatttcttattgtccttctctactaacgaaagggcgatgcttcgctcgattggaatcatacccattatactgttcaaatcatatgaacttttaaccagagtgtgattgatttgatagaagctaaaaatttcatctgggtttataagaagcttaaagactgataaaatgtcttcatacacatttgttcttaactcacagcatttcattttaagttcaaatctcattggagttagttgagtgtaaatcttttcaaacgttgtaaagtcaattgcttctatcacttggatttggttgtcttctgacatctctttccaaggataccattgattgttgtatttaattgctttaatacaatcgtaaatcattgcagctttatcttcgtattccttctcagggaatttaaaagctattgtgattccggcaacttcaatagtaggctcaaccaaatcttcttggctgatgtcaaacagaacttgcttttgtttttcgcaagtcggacaagtgaaagctactggaatttttgttttaccgattgagccagtgaataccttcatgaacatgtatggacgtaaagtctcaggatattcaccaaagtaatcagctaaaagttcttttataatcaccttctgctcttcgtaagttttatgttgcatatcattacgaaccagaaggaaatctctgtaatcagctaccgtgaagggtttaaaacgatggaccccgtccggtagtacacaacgaattatattggccatagaggtctcctttattgaaatatttataaatagtccgtaaggagctaatatgaactacgattacaaatttgaagtccagattaatggctctgatatccaatgcagagcttttacgttagaagaatacaaagagctcatcgatggcaaaatcaatggaaacattgatgaagtagtaaaacggctgattaataattgtacatcagcacgaaaccttaacaagcaagagtcagaacttctgctgattcagttatggtctcactcattaggtgaggttaatcatgagaacatctggatatgtccagaaggtcacgaaacattaacgccgattaactttacatctgcacaaatcgatgaaccagaggaactctggtatcctctagcgaattttaaacttaagcttcgttatccaaaattattcgatgataaaaacatcgcacagatgattgctacgtgtatcgagtacatctatgtgaatggtgaaaccatttcaatcgaagatttgaatgacaaagaaatcgatgacctttactcagctatcactgaagaggatattatccgcatcaaaaatatgcttttaaagcctaccgtttatctagcagttcctgtgaaatgtcagaaatgcggagcaactcacgttgaagtgattaaaggccttaaagaattcttcaggtatctgtaatggcaaatataaacgacctttattcggatttggaccctgaacttaaaatggactggtccaaagacgttgcacgtgctcgtgggttacgagcaattaaaaactctcttttaggtattataacaacaagaaagggaagccgtccatttgaccctaactttgggtgtgatttacaagaccagcttttcgagaacatgactcctcttacggctgacacagtagaacgaaacatcacatctgctataagaaactatgaaccacgcattcgtcgtcttcaggtgaacgtcactccggtttacgatgattacacgcttatcgttgaagttcagttctccgtcattgacaacccggacgaccttgaacagattaagcttcaattggcaagctcaagccgtaactaatcgctttcatttcaagatggttataatggttttgagttccttgctagagtaacaaattgaacaaagaaaggtgattatgaagcttgaagatttacaggaagagttgaaacaagatttgattattgattcaactaaattgcagtatgaagcagctaataacccagttctttatggtaagtggttgacaaaattgtctgctattcgtaaagaaatgcttcgcatcgaggcttcgaagaagtccgcgttaaagcagaagttggattattacacaggcagaggtgatggtgacgagttcagcatggaccgttatgaaaagtctgaaatgaagactgttctgtctgctgataaagaagtacttcgtattgataccagtttgcaatattgggggattttgttagagttctgtcgtgacgcgatggacgctatcaaatctcgtggattctcaatcaagcatattattgatatgcgtaaatttgaagctggtgagtaatggatgagtttgaaactgaaatacagtttttgatgaagtcgcgacgtgttagaagggatgatattcgtatcgtcccagaccatccagtcggtgaagatgtactttatatcaaaggaaagttcgctggttacttagatgtctatttctatgaagaaaatatgggaattgacatgcatatgagacaaattggtggcaatggaagtttataaacaaacttataaatagaattgtaactagaggagacaatcatgtctgaaaagatttgtgctgtctgtaagcaaccgattgattcggcattggttgttgagacagataaagggccggttcatccgggcgcctgctataattatgcgattgaattgccggtaagcgaaagcgcagaagagcaattaaccgaaacgcaacttttaatgtagcctagtgttttatgccacttgtggtttgcccctctttcgaggggcctttttattagaagtcttcttccgactcagaatcatccgcagcttcgagttcagctcgtcgccccgccaaagcatcacgtacactgatgtcatcagaatcagctagctcagcttcctttgagcgcttctcataatacttctcaagctctttcaaaccatctaaagtctgacaagaattaattttgctcatgaagttatcaatcgatgcctcgtaaatgatttgttcaaaagttttaagattgctcatagcttcctcaaatatctatttgtttcattacgtaattgaatttttcgtctgcatatctctgaatgcgctccagcgcgtgctttaaagcatagttcaaatgaacgtatttcttcttagcatttgctgattttggtttaacacccatatcatcgatgatatcccatactgtagcaattgatttagaatcatgcttacgaagtacacgaccgatagtctgcagaacgataattttagacttaactggatgagccaaaataacgtggtgaagattcttaacggaaataccagtggagaatacaccgtaagatgcaactacaataatccccgtgccactttcagccatcactttcaatgcattacgaacttcagttgatacttcgcctgaaacgtaatacaccttatcatgtccaagttctttaatcatttcaaacagctctttaccatgagcaacatgtttgaacatcaagaacgcattttcatttcttttggccagtttaacagctaaattagctacccatttgttacgacgttttgcactggtaattaccttgatttcttcttggtaagttttacctttcatcttagtggtgaattcgtctgggtaacgaaggaagattgagttaatttttaagtcagttacttgaccatcttccataagctgggatgttgaaactggacggaaaatttcaccgaacattccaacatactgcattacgttagctttaccgtcttttaatgaaccagataagccgaacttaaacatgcaattatttaaaccggcaacgatagttgaaatagatttgccagtagctaaatgacattcatcattcatcatcatgccgaattgatggaaccattcttttggctgcttaacggctgtctgccaggtagcaacataaatcattgcatctgaatcgcgctttgtacctgagcgaataccaagacaatgttgtttgccaaatagacgataatcgcagaagtcattaatcatctggtcaaccaatgctgttgttggaacgatgattaaaattttaccttcatagttctcaacataataacgcgcaagtaagcattggattaaagatttaccagcagatgttgggaggtttagaattcgacggcgattcactaacccttcaaacactgcatctttttgataccagtgaggctcaatctttttactcccagagtaaatgtcaagattgccaagccagtcatcaaaatctttacgagtaatttcttcagtctcaaaaatcttcggttcgaagtaaactgaataacccatgttgtttgcgaatttacggatttgtccgacgaggccgaacggtaacagacggtcatagttcagaagacgaatgcgtccatcccagtgtccataacgatactttggattgaatttgtagccatcagcttcaaaactaaaatagtctcttagttcatggaatgtggattcatcacactcaataaacacatgactaaaatcatgaaattttacattgatatcgtgcattgccgattccttagttataaatacatttatatttatacacaacgaggctactatgttagataaagattatattgctgaaatcggtgcacttgagaaaaaagaagccaaagaaaagcttgccgagtacgctgaaaccttcggcattaagctgaagaaaactaaagccttcgacaatatggtcgctgaccttgaagtcgaattggctaaacttgctaatgaacctatgccagagcagaatgatggtctttcaatttatgaccttattcaagctgatgacgaggccaaaggcactgctatttttaaagatgaagctaaagaagaagctcgtctgttgattgattcagtaactgatgcaccacaagtaactgtcacagatatcgaccctcattttgctaagccgatggaccctgttaaaggcgtaattcttgaagctccaattggtgattctgttattacagtttcagatgataaagttcatactattccagtgactgcaatcattaaagaagataaggtcgttaaacctgcagaagaatttgctcttccagataactttagtcctactcttcatctgattggtcgtaatccaggttatgctactctaccttggtggatttatcagtggattcttgaaactcctgattggaaatcacatcctctttcattcgagcatccaagtgcccatcaaactctcctgagcttaatctattacattaaacgtgatggttctgttcaagtaagagaaactcgaaactcttcatttgctacactttcataagagggctagtccctctttaactttggaaaatatatggccacctcaattactttagcgccactaaatcccactatcaagattggagattcccagcagttcactgctactttaacgggagcacctgaaggttcaactgtaacttatgaatggatgattgataatgtagttcaatcttcagttacaaacactttagattacacagcagctacagcaggaactaaagttgttaaagttacatctactactaaagtcgatgctgagccagatgatgttcaaagtgcaactacaaatttgactgtaaacgatgtaatgacattgggtgtcacaatttctgctcaatctcaaactattacagtaggcgaaagttataccgcaagttgtggagtaactggaaacccttctggagcaactgtgtcttataaatggtcaactggtgaaacaactgatactgtttctaaagttgccgatgcacctggaactatttcattaacttgcgaagtaactgtcactgctcctggatttgaagatgctactggaacttcaaacgttttgaatatcacagtaaatcctgccgagcctgaaatcccagctgaatgccctattctttatgttcatccactcccatggcgttcatctgcttatatttgggctggttggtgggtaatggatgctattcagaaactgactgaagaaggtaaagactggaagacagcaactgcatcagatactccatattactgtcacttggctacattagctaaaatgatagcagactatcctgaagttgatgtacaagaatcacgaaatgggcgcatcgtccacagaacagcacttgatgctggtatcatctattaaaaggagcccgaaggctccttttgctttttctagagagtggtattataccaacaactttcactgtaggataaagtaatgacaccgattgagattcattttaagcatgaaaacggcatgagctttattgaaatcgctcgagaagctggcattaagccagaagaagctgcactgtattacgcaaaggttgaagctgcccgcgcacgagttaaacgaagagaaatcatcgtctatcgtaaacgcttatctaatactgatgtagaatctcgtcatcaacaactcgtaaaacatatgaggggatttaatgaatcagtatcctgaaaaacaccttggctatgcgaatgtagtcatcaaaaatatcaagcatgctctcgataacacatttgtagctgctgcccatggctataacaaatttttgagtccgtctgcattttctcgtgcgttggctgaccacgtgcaacaagaatcgaagttctataaatctggaacgaagattatggttgaagttgaaaaatctttgaacccatctggaatggtaattgactggatgcggatgaaggttgatgaagattacacaatcgcaagcggcatgaagtgcaaattagtttgtaagcgtgatgctcgtggcaataagaagtacaaagtaatccctctataatatgcttaaagaatccgcgtggtataatggtttcacggattctttctagtacatacgcttgacgatagaaggatagaaccctccctaattattgatatttatacggtgattataatgagtctagctaaagaatacagagcattagcacaaggtgtgcgtgatgaactaccagaagagattaaagctcatatcaaagataacctgcggaacgcagcacaacgtggtaagtttgaaacgttttatattgttccagaaaaatggagcaataacgtagaagctatgaaaggattcttttctaaaaatggtttctcgtatgagttcaatgctggctatcaaggtcagtctttcaaaattaaattctaaggtgaaatatgtttgagaaatattcaacgctcgagaaccactacaatggtaaattcattgagcgtattcgtaatgctggttttgatgtctctgaaacttgggtagcgcgcgagaaaattcacggcactaacttttctgttatcgtaactaaagatagcattcagcctgctaagcgcactggtcctattctgccagcagaagacttctttggctatatggttatcatgggtcgatataatgagtcatttaaagctgttcaagctgcactgactggtgctacggtagcttatcaaatctttggtgaatttgccggtggcggaattcagaagggcgttgattatggcgaaaaagacttctacgttttcgatattaaagtgactaccgaatccggtgaatcatcttatgttgatgatttcatgatggaacgcatgtgtaatgtctttgggcttaaaatggctccactgctgggccgcggtaaatttgatgacttgattcaaattcctaatatgctggatgttgtagttaatcgctataatcaagctattgaagctcatggtcttgaggaagctaatactacaccattccaggtggttgtttcagaaagcaacatcgctgaaggctacgttctgaaaccatgctaccctaaattcttccctaacggttctcgtgtagctattaaatgcaagaactccaagttctctgagaaagctaaatccgataagcctattaaagctaaggttgaattaactgatgttgataaggttgctttctctacgctggcagcttatgctactctgaaccgagtcaataacgttatcagtaagattggccaagttggtccaaaggactttggtaaagttatgggtcttactgtccaggatattctggaagaagctggtcgtgaagaaatcttcattactgactctgataatcctgatgtagtcaagaaagaacttgtcaattacgtgcaaggcgtaattcgtccagtttggattgaactggtaagtaactaatgcgtttggcgttaatcggttctcgagagacgccacgtcgtgttttagatgtcatgtcattaactggtcaggctctttcggagtcgggccatttttcgtattcgggaggtgctcctggtgcagatgaatcatggctcagtagatacgaccgtgaacgttcattacgtatcataccatacgaaggcttcaatggtcttaaaactggagttggagtaaaggtgtggaaagactttccaaatgaagtgagaatcaggagtgtaattaaagcaagagaagtgacaagctactgggatgagtgccgggatatagtgaagactctatttgcccgcaatgcacttcaggtgctcggagaggattgccagtcacctgtggatatggtactattctatgctccaataaaactctctagcgttactggagggacaagagtggccgttgatatagccaagcgtcatggtataccttgctacaatctgtacgagaaagaaatctatcagagatttaaagaaaaatacgcaccaacattcgatatatttgctttataactacaaaagggaaccgtgaggttccctttcttttagtcttcaatgatgatttttggtaacttaacaccaagaagaactgataaatcagaacgtcctgccatcttatccatatccccgccatcaatgattcgagcttccttttcatctttagctacagtatacgggttagcagacagtgcataacgaacgagtaaagctacagaaggctgtaagctttctgggtcaacaattactttaaatgcaccaacgtgttccgggtcatcaaggtcgataccttcagtgtatggagcatagaaaatactcgatacaacttctttatcaccaatatcttctactacaccgacgattacataatcgagtggagtgttagtatcgcaatacagaggcaaaccgtttgccaggaaaccataagcattctctgatagatattcatcatctccagcttgatgtttcaaccaacctgatgcagcaagaacagcggcagcacgagtagatgctacagcgaatgttgctgtaaaggatgttgagcgctgaatatgagaaaccatttcgcataccatgcgatacagagaacgaccagcttctggggcagatgcataagataaatcgatgaatccagtatctgtgataccttcaactttatatcgttttgaaactgtcacaagactttgtaaaatgtctttgttaatttcatcggccatttcagtagccagtaaatcatcgataaaattagaagcatcaaagccgttagcttcaaggtcctgggccaattcaacggtcaagctcgttttaagtttacgagatttaacttgagtctgccatttatcaatttggaatttagcttcagcgatatcagctccagcagtttcaaacttggaagtgatagcagcgtcagacattaaacgagtagtgagtttaaccagagaaatctgaattacaacttctaaatcagtttcagtaatctggtcaaatggattatctacaagtactttgtaaacaatgtcattgtatttgaacaaatcacccttgccaaatgaatctttatttgaagcagttaatgtttcaatagatttacggtcctcagtaccagtttgacctgcgtaggtagcaccagtaaggaacgttaattctttgttagggttcaaatatttgataccgtagaaagcagcagtaggttgagtagtacgctgagtagctacaatatcagagtaaattaatttagtagtagcgcgagtcaatgcaacgaggctaggacgggcagaaattgaactcgtcgttgtagttgattcgcgcagaaggtcatggatgttagccatcgtcgcttttcctctagtggattatacttttatttatcatccgtagaaacaacaatgggagccttgcggctcccatttaattggattacagacctttaacccagatgcgacggaagtacgcgttcttaccaacagagttgacgatagaaggcataccagactgaatgcgagcattcggctgctgtgatgcactatcagcaaacgggttgataccaataccgtaacgggttttgaagcccatgactggctggaagtttttagggtcggaaccacgcagtggagtcagagcaacgtatggagcgtagtagataccagcatccatctcgttagcacctttgtaaccaatggtgaagtagtcctgacgagcgtactggtcgatgtatactttataacgaccgcccagaatacctgcgaacacagtcttagtggtatcagcattgaagccttgacccagaccctgagcagcaggagtaacgccagtgtcaacagctgccagagcgttaactacgttacgagaagcgatgatgaagttaccagcaccacgaccagtctgacgcgcgatttcagcagcttctttgtcgatttggaacagcagagctttgaagctttcacctgcccaacgagcgccacgaatatcaattgggtcctggaagtcgaatacaccagctttagaaccaacagtctgagtcataccggttttacccagctgagcagagtagttaatccagtctacaacttcacggttgatttccagcatgatttcggtagccagaataccagacagttcagcatccgcatccataccgtgaacagcacgtaagtcttgagccagttcaatagagtactgagctttcagctgacgggatttagcttcgataacttgcttatcgatacggaagcccatttcattccatgggttgtcagtagaaccgttgaagttctcctgcagttccgcaacagaggtagccataccttcagcgatttctaccagctgaccagcttcttcagcagctttaactgctttatccagtttttcagcatcggtagcaccagcgtctacggtgaaaccttcagcaacctggaagtaagcgcgaccaacatcagcgaaatcgtgaactacgatagcaccaacagtcagaacatcggaagctttaacagctgcgaatttctgagcagcaccctgaccagagaacattgcatctggagcgtacattgggtggaatgcttctttagcaccagcggccagagggtctttaccgtaaacagcacgcagagcgaatacctgtccggttggagaactcattggctgaacaccgcagatgtcgaaagcaatcaggttaggaattgcacgacgtaccatgcccataacagctggtccaatctgagttactgcgcctgatgtctggccagcagcgatgttttgagcatcataaccgtggtcaccaccaatttctgcttcagtcaggaacgaaccaaatgcttcagcgattttttcatcacggaatgcaggttcagttttaatagctgattcctggttttccatgatttttgcaatcagagcttttttgccagcaccaacgatttcaggcagtgcttcgttctcaagcagcggagtccatttttctactaacggattaatctttttcatgtgttttataaccttttaaaaattaagaaagacgtgccgcagaggctacgtatgcgtccatcatcgatggctgttttgatactttttcttctggctcaatgtgttcttcagtaatgaagttgagaccgtcagcatcattgtcggtagtatttatgctttcatttactacctctttctcgacggagcctttaaccatttcgacgatggcagacagcttacttgagaattcgtcggaatattccataccttcggtcagagaagctactttctctttctgaacgtcggtcaagtctttagttgattccattacagcgctttcacgcagcatggtattaattttttcgtcgcgagcagaaataccttcgaacagattgctgatttcttcacgagcttcagccagttcttcttccatttcagcaactacatcaactgattcttctggcagaacaacgttgtgttcaacgaacagttctttcataccagagaacatggattcaaacagttcagctttgatgcctttatcaacagccagtttgttttcgttcatccattcttgagcgatgtgattgaagaaacgtgaagcatgttctgtcagtttcttttcagctttttcttcggcttcttctttagcgtctttcagcttttcgtcagccatttcagcaattttggtaatgtgggattcagccaattcaacggcatgtttctttacagttgcttcgaatacagtttcgaacttcgcttttacttccggagaaagctcgaccgattcgaaaatactgtccacagctacggtagcttcaatattctgagcttcctggagcaggatgtctttcagcattttgttagtcctgttgttaagttacattattatttataatgctttttcgagactctctacgagagctttaaatgactcatcgtcattctttttggcgacttgcgcctcagcggattccgaaatctgcttcggagttacccaagcatctggtgcagaaggcccccacacagcatcaacgccaacggtgagtttaaatccttcgtttacgatacggtagcctttattggtttccgttaatgagcctagtccacgactagatactccaggaatccagccagcacgaatgtttgcagcgagtttatctccaggaccatggtcaccttcaataatacgagctcgtccataaacatcgtttcctttccaccacatatcttcgatgatgattgcggcttgcatcgggtcaacgttagcacgtggtgggtgatttaattctccaagtgcttgtttagtagaaacctgctctttaatataattagctacggctttttccaatactctctttggataaagacgcttatttcggttaactacttcggcttgcatgaacacgccttcgatgtataatccaggttttaaccctgcatctgagccatcgtatgactcaagcatcggtacgccattcaaaatttcgccgggttgaccccaatgctcaatgagtaattggggttcattcattagcttaatcctaacgcctgacgacgtttcatagctttcttacgtttgcggttgcctcgtacagtaccagacggattagcgcgtttggacttaacgacttttcgagcgatagcgcgacgtttagctttagataaaccagttgtttggaatgcttgacgctcgcgggttttacggtctttagtacgcgtaatttctccacgagaagaaacatgcttaacgataaattcattgagctgcatttcttcattcagtgaacccatagcaattgctacttcaggttcaattggcaacatgttttctacaattgtatttatgtctgctttatcgagagcttctgacaactgcttaaaacgagattcggcttcaggaatagctgcttcgatgttttcaagtacgacttcgtactcatcaggaacaatcagcattgcgactccttattcttcgtcttcgtcttcagaatctttttcatcttcagattcaggtttttctttaccttcatcttcagaatcatctttttcgtcgtcttctttttcttcgccttcaatcataacagattggacaatctcaacacgacgttggctaatcaaatcagcggtctgttcaagcataatagcaccaaaggctttcttagctttaacgaggtcgttggatttgagtgcggagatgaaatcttccattagaaatcctcttgttcttggtctgggtcttggaaacgagcctctttagactctagctcaatttgcttagcctcttggtcaatttgttcatcagtcatttgaagaatagtcttcattgcagtctgatgagaaatatacttaccgataaacggttcggccatttgaagcatattgaatctgcgttcggtaacttcagcatctttaagttcagtgaagtaactgtcacgatgaaatactatcttaatgttatttatttcatctttccaatcatcttcgctcattacgcctttcaaaataaggtttgttttaagagggtcgaggaaaatttcttcaaacttatgctgcagttcacgaatgaatttagcaaattgtaactcgtcacgtgtaattccagttccagcatcaaactgaactccactttgttggtcattcgggatacgagacagtggaacacgtaatgcttggtaaaggttgtttttgaaccaacggacatcgtccatttcgttcatacctgaagcaccaggcatattatcaatttcagtaacagctttgccatcacggcgctgtaaccaataatcttctgtcattgacatattgtgctgctggtttttaattttaccagtagatgcatcatataccacacggtttttcatggtgttcatgatgtgttgcatatgagcagcagctttacgggaaggcatgttccctgtgtcaatgtaaaatactcgacggtctggcgcacgtgtaatacgataaatcaccattgcgtcttcaagcagtttaagctggtttgcaggtttaacagctcggtgcaaataaccgatgatgtttcttcctgagcaatcaactaatccagagtgtgcataaacaactgcagcctttggaattttaatttttgttccagcgtcgtaaattcgaccgtcacattgataagactcgtgaccggtgttataaacgaaatattctttgtagcctttaacaattttaacgcccgcttcagtgtcagtgataacttcacgaacgaactgaatattgcgagggtctaaacgacgaagctcttgaataccttctttcggttttttagggttaataattttatggaagaagatacgagaatcgacataccagcgacggaaatggtcaagaccctttctttcaaaattcagacaagtaagaacttcgttaaattcttcttgtaaacggtctttaatcgctgggctaaaatcagtgttatctaaatccaatgaaaccactggatgatcatcttcgtatacgattgcatctaagacgatttcttggacagcgttatctacttcgtagttattcattaactgacggtaagtatcgataagctccctggtatttttcattcccggttcattttgaccgtacattctctggaataatccagcgcctgcaatgtctccacgttccgattcaatctctgtcgcgccgtcatcaaatttaggggccgtgatagactctaaattattatttagctgctggtcgtattcctgttcgtcgactttggcccacggcgcgaacaaacttaagacgtcaaatttcattagagtctccaataagggttaaagcatactaatatttattacagtttttgtggtaacgagaaatagcacttcttgtgctttcaactccacaaactttgcatacagctctcggttgatttatctttttgccttttgccggatgctctttaccatacatcgggtttccatcaccagtcattaacttagactgatttggtctttttctaccagataacatttttgaatgttctggccgttttataccaagtctttgtattctttgttttagcttagcttcttcagacatcggaattcctttagtggacattccaaagaacccatttggttgagcaaaagacatattgatataatttttagagcgaactacgtcatactttttctgaactcttaattcttcattcagagcatcttgatgagaactaaaagttttaagaattcttgttttaaacaaatgaggattatcacgaagttcagaaatccagatttctttgtatttcttagacttaacagacccatgataattttcatttattcttgatatagtggtagaaccaatataacgacggggaagtttattccccgtgtatatagtaagataagtgcaatacatattcaaaccttaacttcattgtttgaatatatttattacaaccaccagtcgagacagaacgttacttcgaatgtttctacctcattattcgaatcccaatctaattgcacttcaccaacgttagttggccaaacgcccgtaatttcaatttcacgagtaattgttttactatcacgtgcgaattgacggacaattgcttttttcttatactctgcaggcgagccaccagtaatttcattaccctgacctgctgcgataccctgccattcaacaatagcttgacgagtattatgagcatcatcgttatagatagtcacggtccaatcgtcgaatgtacggtcaccggcaacgttaagtttacggttcatataaccgaccggaattttttcaacgataccagcaggcagtggagctgctttacatttgaagctgaagttcttaccgagataaggaatttctacctcaaacaggttaggacgcgcgaaatcaccggattcaaatgctctcgtgaggtctgttaactccatgagattttccttcatatttatcaattagtgttaaaagattttctaacgtcataccgttagtatcagatttttccaaatttttcttccaaggaattatctgtaaattgcaaatatgacctataatttcaggaggcactgaattatcgtaaccaaatctttttgagacgatatggtcaatttgtgtagcaccttcaataccatttaatccaatagaagaaaatcctggaagttcttgaattaacttattgaatttatattggtgtcttttaacactcatacagtattgatgatatttctttttgtcaatccaatgtgattcaggttttaaccctttaccaacacgattcttggatatagcatcacctctatttttggctaccgctttaccttgaggagtagaatagaaatctttacgaatttctccatatttctcccatcgatggattttgcaataactagatgctatatcatttaatttttcgtttgttacagaatattcaattccgcatttatcacaaacgcaagctattttaagttttccaggagcatgttcagtttttacttgaacatattctccgcttttagcagaatatccaagagattttaatttagctaaattgcggtttgaaacttttacgagatgaaagttattctttatcatacgaatatttataccgctctgattcaccagagcggccgagatgaattagttttcctaagatgattgtatttatggacctcctctcgaaggtccctaaatgtcttagaatttatgagagtaaatcccataaatcaatgctgtttgttccagcttttctgcggttttcttcccaagtgattatttctaaatttgctaccgaagctataatttctggagggattttattgtaaaagccatatttaattgataatttatggtctaactggtatgcaccttcaacaccacataatccgattttatcaaaattttcccattgtgagtaaattggttttaattttttagttaaccaatgaacttttccagaataaattgcgtattcgtctttattgcctttccatctaggatgtttttcacctaactgccaaggtcgttcttttccgctttgaactatactatttttcttagcaactaatttggatgaacactttttacagaggtgttcatcttggtctataacttgttgcaaatttcgttcaaattgttgagaacatttatcgcatgaacataaaactaatttcatacttttctttggcatcttagaaattggtatcataatagtgtcatgataaccaacttcatatcctaaaatttctgaccagaaattcttgtggtttctaggttttatttcaacttctttagtaataatcacttaaaaatctccaatcggctacattgtagccgattgtatcacagaaaatgctaattgtaaaccttattgagcttgtggaccaatcagttcatcaaaatcagcaccagtagccgttgcaacgaaattaagaacgatataatttatcgatctcgcaggctttatatagaacgacgcaacaaactcattgcggtcgattacagcaggcgtgttgttcgtagtatcacataccacacggaattcatatacaccgcccagagatttaattccagacaagtactgagaggtttccatacggaagcttgaacgagtgaagttgtcgttcatctcgaacagacgatatttagaagcgtttccaatattcgttttcagcatgttgaacagacgacgtacgttgatgcggtcaaacggagtaggaactttggttgcagtcttatcgccgaacagaacgaatccgtcaccaccggtgccagtaacagggttaattgcttcctgatacagacggtcacgttggctctgacgaggttcgattgccaatttaatgacgttcagaatctgtccacggttataaccagctggagacatccaaggttgactgacattatcagtacgagcacacagaccagccatatcagcagctaacggaacccaacggttaacatcattgtatttgtcatactgatatttgtagttaccgtcgatagatgcgtaagtagaactgatgttcatattagcatcagcgtatgtaccttgacctgtacgccaatcgaccagattatcaatcgcacgagtcagaggaatgtttaccaatacgctgcgtggcggagagataagagccagacaatcttgacgttcatcagcaatcgatactacatgtttttgaacagtagatgcaaattcgtcatcttcaccagcgcatgcacctgcaatcaagagattaacatgcagagcttcacggtcagcaaataaatcccatgcctgcattacatcaccagctgtaactgattcgttagctgatacaccgcctgacagctgaacaataccagagaatccagttggccagccttcagcagtagcgaagatataattgcttgaacctttagagaagaaatcatcgataaagatgttatttccgtaaacgtccttagaaccttttgcagtagacagcacgaaactttctacaattgctccatcacgacgaacgataatgcaatattggtcatctgactgaggaccatatccaaatacagcacgtgctgttgatacacgagttccgccagcaggataaattggaagctgcgtagcagcaccttgttcaaatccagctttagatacaatttcaagttccaactgagaaccaagttcacctggataaagagcagcaacacctggcatgccataagtttttaatgcagtttggaatgctacggaagtcatttgctcggtagctgtttctggctcagttaaaagaacaccagaatcagttacaattttaccaacagccagagtagcagctacaccagaagatgcagaagtaacttcggcagtccagtttgccccaaggtcaggatattgattaattgattttgcgtatgcaataatttttgcgcttggtactgaaactgaaacaataccaccgttaccatcgacagcagtaactttaccagctgattcaataacgtttacgttgtatttaactcgaacggtatcgcctacagcatagtttgaacctgcagcagaaatggtgatttcaacgttcccagcaattggggatgagtttttagctacttcgcgatttactgcgcgagaaatacgaagatcattaccatattgcaggaagttcattgctgacataaagtaatcagcagtttcgctatctggagtgccgaaaatatcgactaattcgacttcgttagtcacttgaacaacttgaccaaccggaccccactggaatttaccagccagggccgcacgcccagtagcattattaacaatagtgctttgtacactagtttctttgagctcaacgcccggagataataaagccattaagaattcctctacatgtgtgctttagtatatttatataaacgacacaccgtgagttggcgtgtaatctgtaacgtcacgtccgtcgtctactaaaaccactggagcgtaatcgtcattcatatcttctaattcgttccggaatacttccgaagcgagtcgaaggtcgtctttgtcagcataatctgcaaacttagtttgcgttgtaagccatgcgaagattacgagacccatgattaagtcatcatgataaccttcttcagctgcccaggatactcctttttcagagaatgtcctgaattcttgaacagtagctttgtgatggatgataagcttatctttttcaataaggtctttaagcgtagaacaaccgattgctttagtacgcttagtttgtttcatcccaaggtcaaccattgaatcacaaataacgttttcatattccaaatccatgtaaagagatttagcaactgacacgccagtactattcagttcaatataaactggagcttcgttgtactccattagatatttatgcacgatatctggaaggataagatgcgatatgctattggagtgaagaacaccaacctgttcccattgaggttcagtgatgtcaattatatgtaatgcatgatagtcctgtccacgaccttctgaacagtccaatgcagcgatatattttctttccggctgggcttctttaaacttatagaatccatgattgtctggagttacttcagtccaatccatattagcaagtttcataccagaaatcagggtgcctgaagtaccatggaattctgcgcagtgctcttgcttaaattgttctaacgaagaagctgaaatagtctgagatgaccattgccaaccatcatcaaacatatcttggtcgttataaagacgctctttaaccgagttccagattgcagtgtacggctcaaaaccagacttaccagataatgcagcatcccaaatatcgtagaagtggttcaatccatttggtgtagttgtgataataatttttgaacgacgaccagaagaaattactggctggattgctaaccatgcatcgataaagtttggaataaacgcacattcgtcaatgtagatcatcgcaaaggagttaccacgaacggcgtcaggagatgatgcatatgctccaattgaagaaccattgtcaagctcaattgagcctttgttccattcaacaataccaggttgtaaaaagtccggaagtaattcaatagcttgcttcgtacggtccaatacttctgccgacattgaccccttgtgagccagaataccaacagccttatctttgttaaaacaaacgaagtgtgctaaaaatattgctactactgtggttttaccaagctgacgcgacaggttacaacaagtcatacgcttggaagacatgattctcaacatatctcgttgataatcacgcaattgaaccttaattgtaccatagtcaatgtgtgtaatggcacaatatttttcagcaaaataaacgatgtcatcacggcattttttccattcctgaaccatttctctggtccagttggttttgatatttgctcttttaaggttcggaagccccatatatctggagcgtttattattcttgtctttaaatgtaccgaaattagttgggtcttcgccctgaagacgaatctttacaatttggtgaatgcgaagataatcttcgaacttttctggataccacttttcatcccattgagatttgaaaaatgttattccatcctcaacctttttctctaaagaccccggcggacgaatgacaattttctgtccttcattcaacgggtgataatcattcagtacgttaagaggctgttccatttattaccttctcttctctggcttcttgcgcttcatacgcatcaccatattcatccatcatatcagaaggagaacctacaaaaacagtagcattattgatgttcactgcttgattgccagcaccttttgtattagtgttctcattggtgatttccttcatttccttatgcagtcttaacagttctttgttagtagaagtcatctggccgattaatgtagaaaatacttccatgtgacgaggagaatcagagttcttcgcggtttcaaggaatattttagctgcatccattaacatttgtgattggtgatgcatatttctacgaactatcgtatagtcatcttcaaggtcaggagttctgttttgtggatggctttcaactggaattaattgaagaggctcatatgccagaacctcttctccggtaattccaggtaaatctccaatatccagcaatttagtaatgtctaattgttcgctcattatacacctcgtggtccagacggttcaggctctttcggaattggagttgaatcgctgtcatacttctgaatagattttccgtcccagtcttcaatttcaacatcacgtgggtctacttcagaatccacagattcaaatacaccctcatttactaattcgcgactattagcgtggaaatcaagataaattgtacgaatttctccgcttaaatcgaatgctggcggataaagccaaccatttacttcaaacattatagcccattctaaacgtctacgagattgtttttcgccttcaatttgttcatctattgaaatggactggaaagttattcttatatctctttcaaatgtaatttcgttttcgaatagttcagtcattgtggtgttaaaatgaggttggaagtagggcataatttgctctacaatttgaaacatatcgtcttgatgacgagtaaaaattccaagctcaaaaatcattttaatcggagttgggttatattgagaaatagtcccagtcttcgaatcaggattgctcattgctgaacgattaagttgtccagtcttataagttgggttgtacatcatatcaactaaatgaaggttgatacgtggaagaattgtctctactttcgcaggaccatcttcattattaacagaagtccatttattcagcttcatcataaagtgctctttagaagcgtaagtaattgggactctgatgtatgtcttgcctatgtcttcgcgcactctttgaacttgaatattggagaacaagtcacccagcattaagatgtatctgcgcaaagacgagttataaaaatatccgaacattgtttctcctaacggctccgaagagccgtatatgcttttaactatttatagcataaaaccatcatcaaatggagacgtatgattagctggtggcctgtttcttggcggttctaccttaggtgaaccggtaccattaacaacttcatattgcttaacatctttatcagcttcgtcattcatctggtctacttcctgatatggaacttcattgatatcagaaagaccgtctaattcatgaatagggtctaaatcaagctcgctgaactcaggaatattaattccatcattacgttgaagttcaggtttaagctgctctccagaataaatgaatttctctgctgtaatcttacgaatagcatttcgtccagcttgatagaatgggtcatatggctctacccaagaaatttcaaacaagctgttgtccataggaaagtaaattaaatccccttcctttggctcttgtccatttacttgatgcttaaagaggcctgggttaattgacaaagtaacttcgtcattaacttgcataccaaacttactataaaatgtatttgcaccttcataaccttcgaatgagttaatgtaggctgcgaattgccaagctttagtgaacttggactgaaggtcttcaccaaagacatagtcaggttttacatattcacggggaacgtaataacatttaaccccgcgcatttgaatactttcagcaacaagagtatcaaataaagcttgggtattaaaatgattgtggaagttcacataagggttgagaacttcctcttcattagtgcgtgaataacctgatttgtcctcgagcttcgcgaacaaatttttattcatcatcctacaagtactcctgttggagggtcaagtaagtaaagctgctctaaagcatattctttttctaatcgagcttcttcaattaaacgttcaccatttaatgtgactccgcctggaagctgcatgccttggtgacgagctaatacttgaccaagtaattctttagccagaatatgagcgtaatcttttacccaacggttgttatatgagccttgaacgattgaaagttcttcaccagctctgtagccagtcaaacgtttatctgggttatcatacatgtccggaagagtccaagatgattctggaccagctgttccataccctgctgtatttccaaccattttgtccacatcaatataagatttagtccagcattcaactacaataacatcacctagctggaagttgcccataattttaagctgaccagtagcatcgttgaaccaaaaatctggaagaggagcaagcatgtcttgcatcatcgaccaataagttgtgagctgagtgaaatagccaagatcagctccaaaggcatttggcccataagctttattacaagagctacccataccaccattaattccagccattcctaataggaaatcagtgaaccatggataagtagcattaccgtccatacttgtcagtgaaccaacgttagtacgaacaatttgtgtgactgcgaaaatgttgcggtctgaaaaatcaaacacaccatttttgaattgaccacgaccgatttcgtcatcgccaatatgaattacttgatagcctttatttaagccgtcataatgatattcaccgaatagctctaaagctcgttggatacagtcataaatcatatcttcggttaattcaacgttaatgattggtgcgccaagacgacgcaaaataacatcttttaattcttttggattgcgtgcggtatttgcggccatataaacctctaagggcccgaaggccctatattatgcttccgggcctggttccggagcaggtggattaagaatagtgtctaagtcgacccaagcaccgtctttacgaacataagcttttccatcacgaggagcttctggaattaagttctgaatttcggttttaatgtttgaaatatcagtgtcttgggcttttgctacgtttaaaagtcctctttcttcaacagtagctccgttagggtttgtacccattacaagactatttaaacgaattacttgaccttttaaaccttcgttattgttaccaatatctacctggatatcctgaatggtattagccatttggttttgcatggtagtcagagtattaatctgtccaattaaagaattagacggagcaggggttccgctttcattaataccaactacttggttaatccatgcaacttgtccacgtaaaccagacgaagtatctgcaccaacaatagatttcagagctgtaatttcatcacggttaattttaattcttccgttgatgcttgatggctgagaatcttttccgatagctgattcaattaaatctacgcgaggaattaatcctactgtcgggtcacttaatttacgattgacttcagcgattgcatcgcggttaattacaaccaagccgtataaattgataactccattgttatacccaatcgaatctaaaacgttttccatgtccattgctaaagtactaatagttccattcattttattcaaacgaacgtaaacattatcaataccagcggatgctcttggacccatttcatttcgaaggttttggacttcaatagttaatgaaccaacatctgaatcattaaattgtttttcaatattagtgatacgaatcgagttatcattcacagctttagcagtgtcaataacacgcttcttcaaaccaagcgctggagccataggaatagacataccattgatgtcttgccccggataagcacctaactcagttttaatccaaagtaagtcttcacgaactggacggtaaacagaatcgcgtgacgggtcatattcacctacatcttcttcgatgtgagttatgcgcagaccatggtcatctgatgtggttttaagtccctctgtgtcactctggagaactttaattgcagatgtgtttaaacctatttgtttgacaacatcgacatccccaatgacccctagggcatcctcgacattcttaattcttacgtttgattgctcaagagagttacgtacaactacgatattcccatcgagcacttccacgttttgttggacctgcaccggtccacggttgagattaccgtctacaccatttttggtggatgctcctgttaattcctcgccatttttaatccagtttacacgagattggccttcatccggaaggccgttgacgtaaggaaggggagttaaatcaatagttgacatatttttccttatcttacttttattacaaagtttagagcaattgaccaaggacggttttcatcgcccattagaccttctgtattcattgtaccgaatgaatcacgaatattggctggttcaacttcatcgccatcattggtaaaatacttgtagttatcataatctgaacgattagaacctaaataaccgttgcgaacagtacaaccatttcttgcatctgaacgcttataatgttcaccccatccagattcgtgtttgtgtttacgaacagattgcggcatagattgaccaagcgacgcaccgccgcatccagcgccaagaccaggtttacctttagagtcgtttcctgaatattggttcatgatatttgatttacctacaccacgagggaacataccacgcatatcaggtaaagcaaatcgtgtagcatcaccaccgtacagaataccgataatactgaacaacgtagagaattgtgggtcgcttctgtttagtaaagctccattacaatgcatccaatctgaacttggagggttttgaccaggccacatgataattgttccaataggaacagaatcaactaacatattaactgtagcaatttgctggttgttaataaagccagaccccatatctaaacgaccgtttactcgagcagtaccgaatgttgtgtttccattaattgtttgtccgccgttggtatgcacaacattagcattataagctaaagcggtattagcatcgcctgaacctacggtagttgttaatttaacaagaccctttgttgaagtagtaccgactctttggttcaatccgttaggagtaacgaaaatatctccagcggtgtttgcattaacctcagctattgtagctgaacgagcaagtccacgacgagaagatgttgcagttaaagaagctaatccgctaggagatacagcataaccatcgcgtaatgttccttgagcaacttgaccattagtagcaatacgaactgtaccgctgacagcttcagttgctggaccgtacactggaagaactgcagtagctttagcaattgcacgctgagttttaagtggagtcattgctgaagtatcgtcagtgccggcttcagccattgcaatagtagctaatttaattacacccaaaacggattcttttgctgtacgagttgtgaaggcattatcaattgcgccttttaaaccggtcggaactacagctgcagtagaaaatgttccagcgattgcttctggagtagttgcatatcgtgtaagaccaattgtagtttctgtagcctgaggattacctaaacgctcttttaacgtttttggagtgaccacagtattcgccgaatcgccatcatttacttcttgttgggtagcaatacgaataatgccctttacagtttcagcagcgtcaggaacgccattcacggcaattggttttaaagctgcgagagcagcttgaacgtttgttatatttgacgggaaacttgttcccgccgggttaaacgttttatattttgattcatcactgatgtgatttagagtattagtagccattaacccattctcttaaagtattgtaagacggtaggagccgaagcaccgtcaaacgttaatgattgacgaccaattaattcccaagacccataacctactttagaaggagattgaattgacgctgaaatagaaattccgcatgatgaatacgaaggaagtacatgttcttggttgtctatgtatttaacattcaaaatattaccagcggatgaagatacttcaacagaagaaataatttctcctgcagttatagcattctcaagagtggttttaacttttgcagtaaactcagtatcagtatcacctactagcgcaggtaccatgaatccataaacatctacaagaactgaatctcctgtagtttttccttcaaattcaaccgttccagtaaaagtccaatcatcgatttgctgaataccctctggtgaggtaccagtatcgtttataacaattgagccaataggaagaatagcgaatccacggacatcttctatagcggattggacgttaggaaaatcaacaccttgatatttttgagaaattgtatttgaaccgagcggctgagtattcattacatcaatacttccagaagccagttcatattgcaggaatgctgcagagcgggacttaagtcctgcctttgaagaagatacactaatcattaagaaacccttaaccagcgatatgcagtaatatacggttgaacgttatttaccgattttggtggcgtatgtgttggatttatatttgtcacagcttcacgatattttgtataagctgggccttgttcatctgggtcaaattgacatccaccaacaacaatcggaccattagggtctacaactaaaactttttcagttgttttagctggaggaatttgagcattttctaactcattagtggttgtaccaccagtgccgccagcagtatgactaggatttccattgatgtccaagtcattgttgttcatagcaaataatgggtcgttagtgtcattattccaaccagcaactactttaccttgaccccaaagaacccaagtaccaaatcccatatatgttgctgggttattaggattgaccgcgttttcataaattgttccgattggataaaccaaatcaaacaagttttgaacgttatttacactaattgttgcggcaggttcaggaacaacgttaggccaaccaggtttattttggtcgataattcttactcggccagttaattctaaattttcgcctttggaaacataacgtgcatcagtagcatctaaaatatcttccagctccatcactgtaccgatttggttattataccaagtcagcgtaacgacgtcaccatcttccatttgtctatctgtttcaataccaacgagtttgttattttcatcgatatctaaaacgtaatctaatagactattttgccaagttccgccaagagcctgacaagtgaatgcatcatcagcaacggcattaacacaacgttctgtaggaagacctgcagtacccgcagcgttttgaagaataccattaaaacgtacttccattgattgatggtttacaggagaaaaactatcaataccaaaagcacttaatggaaaatatttcaaagtttttaagtcagcaacaagtaatgagccttcgattgaagtgtcattagtcttagttacgtctcttaaagtaatgctacgacggttatatgaactgcggaattgggaaataccatcaaggtaagaaaccacaataacagtatcaccaacattagctgggtttttcagcttaatgctttttccgtcaagagcaactaatgttccaccaggtccaatagaaccaaaatcagaatcagttgcactaaactgttcgccgtagtacagaatgttaccacgatggaatacttgtgtatttccaatattatattcagtaccgttgaatacatcagggaaatcagtttgtccggcgactttaactaaaaattctttacgaactacagtgctcaattcgctgttagaaattcggttgatttgtttattttcaacatattcccaacgtccaggtggacaataaaccatttctaaatccgcaaattgagtacggatttctcttggattagaatcaccctttaaagtatctccagaaccaggaataatcgtaactggattaacttgccatgttgcataaacatcacgaaaacgaattactttattatagtcgtttgaagttccttttggtaatcttacgttcattcgacctgttgaagtatcgagaacataagctttaccccattcagctgtcaaagtagcgccagaagaggttttatggtttttccatgcacccgcagcaaaaggaacttctccgtctccaagctcataataaagctcgtcgaagttgtcattaatttttatgccgcctttgcgaaggtagtcgcctgaaccgtcatcaacagcttgaccaattttaatttcttgcttcatcttggattcccaattttctgtgtagcgatagctttaactgctgctctcaaaccagcgactcctgccgttaaggtcagaactacatatcctgtggtagggttaatagtgaacgaagggacgaaaattttatcaatcacttcaggagttgttgaagtagctggagtgtctaccgctccaattctaattacagcatattcaacactattaacttctcttttaactttgtctatgtgaatatttatttcgcagctcttagcttttgaaccattactagtttcagccgtgataagatacttcgctacgttaaattcagtgttgtggaatagtggaatatctactgaagttccagctgctcctaattgccacgttccgtcagttggaatatgtttttctccaaacatactctctattgaatagtcccaaactgaacgaccgccttcatcagaaatacaccagcattttacaaatacgtaaggagatgtaattcttaaagagccagttactgttgcaaaagtatcatttgcatcaattgtaagtggattagtaggtgaaaatgagccatttgagttgcagaaaaatactgcttcgccccttacaccctttgataaagttacttgaacagtacctccagaagtatcaatatcatattgtgacccgtttgctactggagtagtaaattccagagggtcatttgatttttgccaatatcctgtagcgtgaattacttgacctataccagcaccttgaccattatcaagggccatttttcgctggtcaccaaaagcattgtaaatgccgttgaagttgtcgttaatcttgttaccgccatcgaacaggatatcaccagtcgatgtgttaccaatttcaccgacgtcaattagttgtttagcttcttgttcgaacataatgagtcctctattgatatatgctatttatacaaaaatgggagcccgaaggctcccgtaattagaattcgaagataatattaatttcttcggtttggtccatagccataatgattggtggtctgttttccatgtaaatcatttcaccggaatgccgactcaaatcaatagggtcataccaaagattcttagccttcttattaggctcggaaggtatctttttagcttcaagcggattagtaattactgaaatctggcggaaccctttatttccgggcaacgcagcttctgggaaatatactgaatcgaaatatgctttaaagcgaatagtataagccttcactcgataaattattccatacgcatcatgttcccattccaggttctggttatagccccaacgttctgggtcttctttaacttcatctggccatggaacgacgatgtattcatttgtgcatctgttaattgaaacatcaggtggaatctcataaagatattcccagagatatccatctttcatgtcaattttgttatcattagttgcatcgcctcttccacgaggaggaaaagcagattgaactgaagatgtccaacgcccacccaacttgatacactcttctttatttttgattgtgttaattgaacatgtgccagcatctggaatatcaatacaacgataaaccatccatccactaccaacttcagtagcattatatggagcactgttcactaccacaatttcgcctattgcgaagtttcttgggtttggataacgaatatcaccccaatcttttcgaggaataattgcatccagcattgaaggcataacttttacgcaacccatcatatgagtccacatatcaactacaccttgagtattatctactggataaggtggggcgaaccccacctccgattcgttatctgaccaaggttcacttcgtccaaaggtgatataaattgtgttgtctttgtcttcatcaccaattgactcataaaaattcagcatcttttcagtacggaattttgaggtcactatggaacgataaattacgcttgaatcattcattaatcttaacctgtgttggattagccgggtcacgaggaatattgactttatcaataagtctagcatcaaccaaatcacgccaattggcgaaagtcacagcactttggtcaaatgtcgggctcattggtttacgtctctctgacggtaattgacctgctataacagagttattgttctcagcgtcataatcagctggtatatcaaatgtttcaccagcacgagggtgtggtaaataaagagcttcaccagtgacagggtcatgctcaataacatcatttgaatttaactgtgctattctatctggccaaattgtcggaagtcctgcatcccatttgtagtttttgtatttattgattatagtctgaacgtgtttcaacgtaagaccgacgttaatgaacatagtcaataaagtaattccaataaatccaaatccaactggatgcacaaaccgtaaaacgtcatttctatatctagatgttggaagatttgatttaattttcattacgtagtaagaacggttacggttgatatattcaatcgtattttcaaccaattctttaccacgaacgccttgaactataataccgctaaatccaggcatacgttctgctttaagctcttgaccaacaatcaaacgacctaaaaggttgtgaatagtaattcgccattgcaaacggccgtcagtgtaattacgctcaacgtaagttacgttagttctgccagtagcagtataaatcgtctgtccaactaagtcatcattaacagaatcagattcaataataatgtcgtattctgttcctgaattagactcaatttctatctcaacgttttcattatacaacagtttgaacaggaattgatacgaagcttcaataccttttgttgaataaaaatctgatttacgagattcaaagaatcttgaaaccgcatcacgcttatcagggttcaaataaatgtttcgtttataaacttcagaccagagatattcccaagcatctttttctctagggtacttattacgaataagattcagtaagttgttatattgggttccatatccgtcagacagatactgaatgtaagcttcgcagaaagcttcaaaattactatcttcaagcagatagctatcaggcatcatagtgttgataagaggacgtaaatcagggtcttttattccgtctctattatcaggagtccaaggaatttctctttcttgattctgcagatatgctttaaggaatatctcagaaggcttccaaagaataagaacttcatctctcactcgatagttgaattcaaagtatgaaataatctcacctgacatcttatggaatagaacaccagaagcgtatttggtaaaattggtaaattcaacgtttggagatgttacagtacaaacacctttatcccaatattcatggagaactcggtctggagaaccagaaccattaacatcaataactttgctgtgaacgatatcagaataaacgactaccactcgatatgaagtatcaatccaacaacgagtttttgatttacgagaccaattaaagaatggctcagcgtaataattcattgcacctggtacgaacgttttaaacccagattttgaatcagttctaaagctcatcatatgataatgcttatctgataaccattctctggtatattcatatttaaccgcaccaagcaattgatattttgcagcagtttcagggtctggaacaacgtttgaatccaggaatttaaaattacttgagctaaagaaaacatcagttccgtttgttgaaagtgaagtatatccatgctcaatacgacgacgctcttccgctgtattgccaaatactctagtccaaacatctccttcgaggatgtaaacaccttttgaatccgaatcaataacgttgtcagctatagtcctgtcatcaaggtcatttttaacttcacctgtgattagggctaaagtaactccgttgactgaaactaaattatgacaaactgctttagaatttcctgtaatacgagaagtccaagtatcaaaaagcttttcaccgaaggttggtgataaagggtcttggtcaataggagcattacgagtctgagctctatatacaacgtcccgaccggcaacataaatcatttcatctgttgcagaaatagcttcagcgtatttctgaaccgctaatggaagacgagcgtaagttccaaaaatttcaacatcgaatccgagtttcaattggtcaccaattttagcaaaggttacgtcttgagaactgaattttacgtcgtctgctgaccagcggatgtcattacttttacggccatagaagaccctgtcgtatcccaggagatacgtagtatttctcgtttggtaatatacattctttgatactgggttccctacgcggtcattgagtaactttacagccttccaagtttgacctttatcgtttgataccttaacgatattctggaatctttcaaagaggtataacaccccttccgattccattagcattacgcgttctttgtctttacagattttggtaatgtcaccttgaatctcatgatactcatcttctttcaagataaagttatccacagatgatgctgtacgatattctggagagaactggaatgtttcatccatcaaagatgctacgatagtgtcgcggttgaaattaacaaagtcttgattgtttttagtgaatttctcttcaatgaattgcttagacagagtcatttcacgcatcatttcaaacgtatagacgttagtttcaaacgtttggaattcttcagttaatttccagtttgattgctcaaacccttcagcggctacggcaacccgcataatgtaatattccagtggacgaataaaatcgtcttcgaaaaattcattttctgcagtataacctaagtttctccactgataattttcagggagcagaggctccccgttttggtcacgagtttcagcaagttcaacgaaatagaagaagttagcaccaacgtcatcccatttaatttgaacttggtttgcagatagttttgttattctgagacttgtaacagaaggtgcttttacagtcattgtgcaataggctccaatgtaatggtcgtgtattgaggacgaaggtcattctcaaatacaattaatgaaccatcttttgtgaaaatgttattttctttaggtagtgaataaagctcgatagattgaacgtcaaacataccagagttgagattaagagcagcgatattccaatagatgtaatctgatggataatcaacttcaccaactacaaaatatgtgtttctaccgtcagtaacaggtaatttatcaaagtctgttccggtgtaaatcggagctgcaggagtagctgcaacatcaccagctttaaatggaccaagaacgattttaccttttttagtatcacctactgtaccagctaagcgtaccatataagacgatgtaccttttgtgaacttaaattcacttgacttcaaactacggggtgtaatctggttatagtatttaataccagctgctggagtctcaaagaagtttgtaacttcacgaaccatttcaatttcagcagatgaaccgataattgaatggtctgctctatcgacgtaagttaacattcttgattttgcaaactgagcattaaagatttcaacttcattagtatagtattcatcaattttatcgatgatttgaccatgaagccactgttcagactcttgaagtttatttaaggcataagttactttaatgttatgcttcaagaacagatagttcggagaaataacagatggagtaattgtagccaagttaaatggcttcaagtagttctgaatatcttctctttgaacagaagtcaaatataaaccagatttaggtttaatagcaataaacgcataaccaggtttatactggtcagtaaatgtttggacagcttgaacgattgaaccaaagcgctcagatacgaaagtatcatagtcagttgcagttacgcaacgtgcttgtgtttctcttttgattgttccgagttcacgaatacgttcaatatcttcagggtcaccgccgccgtcagctcctacataatcaggagaatcgtccgggttttcatatattttctggacttgaatatactgcagcgtgtctgcgtaactaaattcagtagcaccatttgctcgttcgccgtcggttcgaatatattcaataacaatagtttggtcttgaataggtttcaaaccgccgatgtagtttgcttcaagagcagcacctgcaactgagacggattgctcaccttcaccgaagaagaattcagtgtgaccatcaacagtttcacgcatgtagtaaattgtagaagttgaaccagcatgaaccattgacttgtaagtccagttagtccattcagcaccatcaacaaataaacgaacttctgagcggtcgatattttcgtctctgatgataatcggtttcaacttattgtattttaattcagtacgaacaatacgtccttgtgctaatttaacacgagggaaatataagttgttctggtcttttaatgcaattacgtcttcagtagttacgaatggatatgggtcagcactcgtatctcgagcatatgcaaggaatcttgtaccacgagggattctaacactgttttcattcaatgcgtgagtacattccagcatgatttgtgttttagctgccgaacgagaagatggaagatatccattatcttgagctgcttgaacaactgagcttctgaggttagcagtacgcatgaatgattcataaactgcactgttaccaaattgctgaatgtaaagagtgttgtatgctaaaaggtccagcaatacgttcatgcgggagccttcgaaatcataatctaagaattcgttttggccacgcagccaatcaacgtagttctttttaatttcttggaacgtgccgccgatgaaaacttcaggaatcgcattcgcggttctttttaattgatagttaaagggttcagtagttgccattgttttatccgtgaatgaatactttgttactcgattcggctacagtgtcaccgcaagaaatagggtcagccatttgaacggctttctttcctgtaacgaacactttacttgtacgaggttgaacagaacccccgtgagtgtcgtagggtttaactgttttagtatgaggagttatttggtctccatctactagaactgcaattccaccaacaaatacttttccttgagtcgcatttacttgcgtaggaggataagctgagtggcctgcagttaaagctttgtcataacttaatccggccattaataataccccatgcgaattctactttttaatgtagaataaggtatatttaatttaattgatgcttgtttaatgctggaaaatgtagttccatttattgtaatagacttagaattagttggagatttaccatacataggattattttctccttgcatcttaactgtcggggttttgcgttgaccacgcttttttcttgcggctatttgcatttttaatcttgattctattgaatgagtttttccataaaacccatttttatttccagctgtatcatttattggaaatccaccaaatcctccaatcttcatattataagtgagtggagaattaacaaattgggcgtcaactatttcagattcagctaaatacatttcgtctgaagaaccaaagaattttatgatgctcttttcaaaattttcaattccatatttgtttatagcttttctcaaagccactccagaccccatgtaaccgtcatcaaaattttcagtggagtgaactcctacataaatcttagaattcactttattttcaatacagtagagataatagattctatgttcttgcataaacataatctcttaatttctggctccatttgctccaattaccatacactaactgagagtaggttttggtcatttccattttaaccggaggaggtgtgacaggttcaccagatggtcctgtagtgtcttcaccttgtctccaatatataaccttaactgtgtacgtaaaggtcctctcaagtttagagggggctttccagaggtataaatcagctgtaccgggaggtggtaaagattcccatgattgggctactttaaattcatcaccttctcgatatttaagagcatctcctccaaaggaaaagacgctttcatatacgccgctgtaattggctcctgagaccgcaatcccaggagtaggttgaaaatcaattatatttatagactctaatgtgtctgttgcttctaattgagcagtgaatgtttgattaactgaaccgccttcttgaatatcaggcaactcagtgcttactggaagtatgtcaaccattattacctcaaccgatatcgatacgtgaaccgtcgacggtgtactgaccagatgctttagaactcatcgtctgcatagtttcagcccagtttccggtgacgttcattgacacattacccttaacagaccatgtgacgttaccattgacagtgtaatcatggtttccttcaacctgtgttttggcatcacctttcacaagaatatcagcatttccatcaactacaattttgatattacccttcacataaagagttccatcgccttcaatagttttagtttcatcaccacgaataaagagagtattgcttccatcgatttgagtggtcttattagccatgttgtaataagtttcatcaccaccgacgttaactttcttatcgcctgaaattaaaatattgccgtcaccaccagtcatatcataaaggtcaccgacagtttttcgtgttcttcgtccatcgggagcaacttcttcatatgttcctgttggatgaacaatacgataacgttcgtatcctggagtgtcatcaaattcttgtatatgtccagactcagtttccatcgtatggacgtaaggatactgaccattgtatgaagattctggttctttgaataagatgcgcccagtctgaggaattggtggtccccacgggtcatctgaaccaactgccgcggcaactgcagctgccgaaagactttttgcgcttggaggagaaactggaatcccgtatgattctaagttaccagttaaaatgatgttagacacacgagaagctcgtcctttggtttgttgaaaccagcgagaatttcttgcttcattatatgcggtcttccaatcaccaatgtacatagcagcaagcatattggtaaagtttgccaaacctcctacacccatctggaaactcatattttcaagagccatttggcgagatttattcattttggcgtaaactggaccaatagttgagttagtttttatatctctttgaactttctcaacatctttactaaatagcatcgatgcttcatcaacggaaatagaacctggatttcctgttacttctcgtccgatttgattggataaggctttatttgcgccagccatatctcctttggtaaattcaccaataaagtgacctatacctacagtataacctctaacgtcccagtatatttttaaacgaagaccttcatcacgacgaagcatagcttctattgtataatttggattgttatcttcgggaatattagcaaggtcagtatcatctggattaatgccagtatcgatattgttatcttgaactatgtttgcagtataatcatcgccttcaattccaccctggttcaatgcgttggtatcattaccaagatatcgaggatattgtccagttgggtcagaaaatccttctgttctgtttggacgagcagttgcattagctgcatacgtcccaagaataattccgttttgtctgtatttgtctaagaaatgaccatatacatgagtaccttcaacaggaccggtaacagaaccaccaacaccagaaatagctgcagatgtcactggaaatataggactcatccatggcaaatcttcagtagggacacccatgataggtccctgtgttttttggaatggatgaagaccatgaacacgcactcggacacgacctcttttcaaagggtccattcggtcttcaacaactccagtaaaccactgaagagaattattaatcatttccattatgcaatctccatctcacggattaaatcagcaatgaatgtatcgatatcagcaggagagataattttaatttgtcgtttagtttcattatctaaaattgcagcttcatatgtgtctacagctgcaagtgctccctgatattgaggatgttcttgcagcaaatctcctttatcataccaagtaccaggagaagttttagattcaactaaattgtaatatttttcgccttttgaatctacatgataaagaacctgatttccgccagcattttcatatctctgctcagaagctctataagcagcttcttgacttgtaatccagccataatatgggtcataattatcattacacatcagaagaacccagtataattgagggtttccgtatatagtgtaagacaactcttcaggtcgtggagaaccttggatgtagtaagtgcgcaaacgatagttagcggccacgcgcttaaaataagccttataatttctgaaaatgtcagtcatggaaattggcttggcgttttcatccaccgttttagcggtgtaagtaatagggtcaaaaaatgagaacagcatatagcctccactttataaatagtaatattatttataagaggaaaattatatggcgtactcaggcaaatttatgcctaagaaccatgaaaagtacaggggcgatataagaaaaataacataccgctcatcctgggagtcatggttcatgaaatggcttgatgcaaatccacaagtagttaagtggaattctgaagaagtagtcatcccatacttctgcattgcagaaggtaaaaagcgtagatacttcatggacttttggttcaaagatgaaagtggacaagagttcttcgttgaagtaaaaccaaagaaagaaactcaaccgcctccaaagcctgctaaacttactacagcagcaaagaaaagatatatcgatgagatatacacatggagtgtgaatcaggataaatggacagcagctcaaaaggttgctgaaaagaataacattaaattcagattgcttacagaagatggtctgaaaagattagggtggaaaggctaatggctatatttgaattgcttaatgaaggtgctcaaccgatagctcgaacagtccctaaagatgaaagaaaatgggtagagataggtgtagaatatgctgaagcgaaaaagaaaggtgccaccgccaaatcttttgccgaagaaaaaggcataaaatatgctacatttacaaaggcgatgagcagatatgcttcgagaattaagacagctgtccaagttgctaaacttgaaggaaaaagtccaaagaaacttactcgccaagaaagacaacttgtgatgataaacagcttccgtcagagcattcgacaaaagattgctaatgaaggcgcagctgttaacaataagtcagctcgttggttcaacgagacaatgaagaaaaatattcgtggtcatcaggtatcaaaacctactccaggaaaactttatgcttatatgtatgatgctaaacataaagatacacttccgttctgggatagatttccattgattatttatttgggattaggtaaacaaggctcaactacgttgatgtatggtttgaacttgcactatattccacctaaagctcgtcaacaattcctcgaagagttgctaaagcaatatgctaacactccgactattactaataagactaagctgaagattaattggagtcaagttaagggattcgctggcgcggataagatgattaaagcttatcttcctggtcatatcaaaggaagtttagtagagattaagccagcagactgggctaatgttgtcctacttcctcttcagcagtttatgtcaaaaggcaaacgttattctgctactgctgtttggaaatcttaatccatcttcttccggattgattgatattgattgctccggaagaactcaaaaccattataactattccagagggaaagcgaattggacgctaacgaactttttaaccaaacgaatattactaactttatagtagatattcctgatgctggattgacaaaagcttttacgcttaacgtacaatcagctacaatacctggtatacgcatccctattactgaaactccatctgggcaaggtggtctagcacgttctcaactgccaggctcaacttttgagcatgacccattagtcatacgctttttagtcgatgaagatttaaactcttggcttcagatgtatcaatggatgctttcaatcaacaactacattgattttaactcgcaggcgtggaagccaggttatgttccgccacatatttctgttcatatgcttgataactccaagaagaaaattgtaatgagttttcattattatggagcttggtgttctgatttaggcgaagtagaattcagctatactgaagatactgacccagctgttatttgcactgcaatgttcccattcaagtatttgcaaatagaaaaagatggtaaaatcatagtaggtaaacaaaatatcgaacaggctgctcagtctcgttcatctgttggaatgcatccttctatgaggtaatatgaaacttattttcatcataggtaagaaacggtcaggtaaagataccaccgctgactatcttgcgaataactacaaaactaaaaagttccagcttgctggtccaattaaagatacattagctgattgctggaatccagatttgacccaaaaaactggtgtatctttgcatcgtcttgattttgaaggcaaaggttatgacagggaacagattctgttactgaataacaaagatgttattgattacatgactaattgtgtatatcatcttttaagatataaacttaaagcagctaaaagagaaaacggatttttcgttcatgacaacggagatttttcttgtactggaaaatctaaaattgaagccctaataaataaaaataccaaaccatggacagtacgtcgtctcatgcagacccttgggactgatatcttctgcgacatggttgaccgcatgtattggttgaagttattcgctattgattatgtcgatagtttccatgacgatttggatttttatattgttccagatactcgtcaggaccacgaacttgatgctgctcgggcgatgggtgctacagtaattcatgtagttcgtccaggtaatgaaagttcacaagatactcacatcactgaagctggtttaccaatcagagacggtgatattgtaataacaaatgacggttctttagaggacctctattctaaaattgaaaaggtaattaaatgagcgaacaaatccaaaaactggaagcgactgtaactgcactgaaatctcgtctgtttgacgcaaatgaagaaatttctcagtctcagttggttattcaaaatctgtctgctggtttccaggaaatcatcaaactggttggtattaccggtgatgaaaatggttcagttgaaatcaaagcagttgtagatgctgttcgtggtcttctgcctgaacagcttgaacttgacgaagctctgccagaagctgaatgattaatttccaggacctcggttctggattgtacgttgcagctaaattctccgatttgacattggatgctattgagagccttcagcgagagttgaaggttccaaatccagttccacgacataaaatccactcaacgatttgctattccagagtaaatgtaccttatacatgctcatctggtagcttcgaagttgctcgtaaagggcatcttgaggtgtggaaccatggagaatcccctgtgttagtgctagttttagattctgaatatcttaagcatagacacatgtacgctagggcattgggtgcaacgcatgattttcctgactacactcctcacattacgttgtcttataacgtaggtcctttatcattcaagggtgaagttcagataccagttgtactggaccgtgaatacaaagaaccacttaagctagattgggcagaagaccttaaatgacaatacggtaagagccatagcaaaccgtttactttccttgagggctatgatactatagccctatcaacacaaggagattaaaatgaaacgttgcgaaatcatcggaaacatctttactatagtaacactgggagcgcttggaacttcaatcttcggatggccgttcctttcaaattctgaactcatcagtagcgtagtacttacactcgttgctggtattatttcattcgtcatggataaaattgcaaatgactcaaattaaagaactgtttgtcaaagctaaagaatgggttgaaaaaacttatgactttaattctccaatgaataagtatgattacattcttgttggtactgtagttggagcattgttaataatgattaaaagttttatacccactttgattgtcggtgctattttagttcatttggctaatgttcgtaaaggttaaatgcttaaagagctacttgatattattaatctatcgacggaacatgatgaacaatcttgctcacatgaggaccgcttctaaggagacggtccgaaatcggaaaaagaaacttaaagaacgaatggcgagaatcatcaacaatacgtcgatggagccttctgaaaaagtctttgtgaaaaatgcaatgaagtcaatcttcgatgaattatcgttgattcaccaaaacactgcgagagaacattatgagcatcagcaacacctggaacaaactgtttaactctatcaaaggccttcgttcagacgaatactaccactcttcgagcggtataaatatacctatagaactggttactccacaatggattaagtcagattcaatgggtaatgaaatttctcctggcgatattgtagctttggacaaaagtggaaagtattccggatgcatggttggtatccttttaggatggactgaacaaggttaccgggtagctggtttccagacttcaactaattttccagaacatcgtactattgaaggttcattacgttctccgcatcaagttttcttggttaagcgaatgaattctacagttcttaaataaatttcggggagttaattccgtagaggtagcggtgcagactgtaaatctgttgtcattgcgactcgggtggttcgactccatcactccccaccaaattccgggaatatagctcagttggtagagcaaacgaccgataatcgttaggtcactggttcgagtccagttattcccaccaatttgcttaaagatatttttgttattataaatatctacaggacgttagctcagttggttagagcaccggacttttaatccgggtgtcgatgggttcaactccctcacgtcctaccaatctccgttcgtctatcggttaggacgccggcctttcacgtcggaaagaagagttcaattctcttacggagaaccaaatttcgggtcgttggctgagagggtaagcggcggactgttaatccgtgtcagaaatgactaggcaggttcgatacctgcacgacccgccaaataaagaagttggaagacgttctgacaaagtcgtcggcagattaatccctgaatatgagttccctcaacgataactacatatctcaaattaaatacggcgccgaaagtttactttcggagtatattgatgaagttattgtgttaacgaagattatatctgtgcacgggtatatgagagccaataacgcctattcagctttccggaaggcttgagggtaatcccatactcacgaaagtaaatttttggacctatagtttcagcggtgaaaatactcgcctgtcacgcgagagtcacgggttcgaatcccgttaggtccgccaaatacgaggcagttcctgaagatggtggtccataatgaatgccaggaccagtgattttgttccctcacaataggtgagttctacataaagcagccgttgtacttcaggaatccggataagtgcgggttaacttcagttggtagaatgacgggttcatatcccgttacgcgatggttcgagtccatcacccgcctccaaacacaccagagcttaggatgagaattgtgtccggcaatggaatgcgttattggggtatagccaagttggtaaggcagtagattttgattctacgattccctggttcgagtccaggtaccccagccaattatagtcacatcaatattcattctagacgacgctgtttgcagcttccggataagatacgcgcggcttttctggaccaatcgtgacaacgcatcttgattgcaagagtggatattgatgtggccgtagttcagttggtagaactcgagattgtgattctcgtagtcatgggttcgactcccatcggtcaccccaataaatatagtaaccaaggagttactatgaaaacttataagcagtttcttaatgaaattattgagaaagaagacggtaaatatgatgttaaaactaaagatggtaagaaaactttaggtactcatgattccaaaaaatctgctgaaaaacagcttgctgctattgaaatttcaaaagctaaagctaaataacggaagcgtggtagagctggcttattgcaccggtcttgaaaaccggaggccgtagcgatacggtccgtgggttcgaatcccaccgcttcctccattttaggtctctcgtatagtggtattaccctgagctccaacctcagtgacgtgggttcgattcctacggggcctgccaaaacaatcggttcgtggaattgtctaagccgtaagccgagtagcgtttttgacgaaacgttcggatatggtagaggcatggccttatccaaaatacgttgcagcgtcaactgtttcgtaaccaggttcgaaccctggcgttccgtacaaaatgcatccatcgtatagcggctattatgactggcttccacccagtagatgagagttcgattctctctggatgctccaaattaacggtgtgtagctcagtttggtagagcacttggtttgggaccaaggggtcgcaggttcaaatcctgccgcaccgaccaattgggaagttagctgagatggattagcgcgtgcctgaagagcatgagaggttggttcgattccaacacttcccaccaaatgacgccccgtatggagaaatctgtacggggctttttagtgaaaacgctttaaaaattcagtatataattaccttatcaaaaccactaaggaaaaagaatgaaacgtatcgttgttgaagttaaccaaatcgctacatttgcactgactggtaaaattgttgatgtatctcgtgcagtagttcgttctgataaaatcgtaggtttggttgaaactgttgacggcttcgttaagctgaccatcaaaacaagcgatgaagctctgccatttacggttgttatcaataacgactttgatgaagtcgctgatttcatggtagaataatctgtcctcttcggaggactctggccccgtagctcagcggtagagcggtcccctcataagggattggtcggcagttcgaatcatgcccggggtcaccaaattctgaggaaaatattatgatttattatggttgcactcactccatcttcttttctgaagattttgttcgcgatatcatgcttcgtagtgattacgcgttcactcaagattctaagtccggccattggaaatttctgaaatatcgttattccaaagaaggactaaacactcaattctttaatgttcaagacctgcttgattatgtttacaaagatatgatgaattgttttcatcgattcccgcgtgaactgatgagtcatttaaatccattgcctgaacttgattattctgacatttcgcaattctctcataaagacccttactctaaagtaattgctaaatggagaatgttgatagatttgtacatgaaaccacttccaccatttaattgaaggaaatattatggaacttcgctttggccagactatccctaaaggttatgcaatttcttgtgtatcatgggaaaatgatggcgatgattatcaagagaatgtgatttacaatgtaagtgccagacacatttcaggttggtgcgctgttgcaaaatgttttgcgtctactaactcagactctaatggaatgggtaatgaagattattccggtgatgctttctttgaatattgtgttgaaaatgaagaaatcactccagaattctgtttagaagtgcttggctttgtaatcccagaaggtgattacactgaagatgaattcgatgctcgtcttgaagatttctatcaagttcagtataaagtgatggataagattcaagaattaattggaactccaatcggatatgatactgacttcatgcgtgtagctgaaacgtttaagctcttctacattgaagaagatatcattattcctaaagctcctgaacctatcactacggtgactatctgatggaaaccgttgacttcgttatccaggacttggttactgaaaagttttattgtttagatgacgactcggaatttggcgaaggctggcgcttaggtgatatctctgaagccgtcggcttagacaccgaagaccaagcttggcagcttgtcgagtatgacgaattaactcaagttacaatcaagaagagaactactcatgtcacatttgaaagcatttaagaaacgtattattgatgcgattgaagagttcgcgaatgctcgtgaagtttcaatcaaggcctcaagtaatggtcaaacttatgaccgttacgctcctgaacatggattacataaggttgattaatggatatcggctctggaagttcatatccttcttgtgctttaagtaactttgcacctcatgctttcgtttatgatggtgtagaatgtgcctcaatggagggattcttgcaatccctcaaattttctaatcccgaaatgcaagctcatgtttgcaccttggttggaaaggcagcaaagttcaaaggcaagaagaaacgttggtggcctactcaaaccctttattggaaaggtgttcctattcatcgagcatctgaagcataccaaaatattttgactggagcttacgatgcactggctcaaaacactggttttcaaaaagctttgattgctactcgtaatgcaacattaactcacagcatgggcaaaaacaaaatttctgaaacggtcttgactgagaaggaattttgcaatcagctctatcgtttacgtaaaatgcttcaagagaaatagattatgattaatctgtaccgacatcctgatatgaatgttcgttatctcgttgatactgaatcaaatcgagtactcacatattggcatgatagctgcttaaacacaacttatcttgacccaattgtgagaaagaatttaattcttcttgaggaaaatactcaggttgaacctgctcttcattttgatgagtatttcaaaatcaactggtttactcaggttgatatgtaataaatatcgttgttcagtgctgaaattggtaaacaaggggtccaacaccttttgagttcgcatattgcatcatatgctgacgatggtggtaaaacgccgcaagaacatgcttacaggttcgagtcctgtctgaacacaatcggggtatagctcagctggatagagcagtggacttctaatccacaggtcgatgggttcgaatccctctgcctcgaccaatttgctagggttgctgagtggccaaaggcagcggattgcaaatccgccgggtatcccttcgtgagttcgaatctcactcctagctccaaatttcgcatcgatggtggaactggtatacacagaagacttaaaatcttccgccgcaaggattgagggttcgaatccctctcggtgcaccaagccggtttagctcagttggtagagcagctcatttgtaatgagagggtcagcggttcgaatccgttaaccggcaccaaatgaggaaaatataatgcgtttagttcaagtacgttataaaatttctgaatacatggaagacgacggaaaggttgaagaagaattgttcactgtagacgctgattctgacggtgaagctgaacaaaaagtttataactatttcaataatatctcagacccatatggaacgagctattatgtttatgattgcgatgcggttaagcatctaagctaatacagagagttgcagctctcgtatgaagacgtcgtgttagaagagaaggttagcccttgccggatggaccatgagtggttcccggttgttaatcacctgcaaagtgacacctccatgacgctatattcccagtggcgagactgatgcctccgagtcgctgggaacgaacttctgcagaccatctgccagtaggtggtgctgtcgattcttacgccctgtcttcggatggggcgttgttgcatataaatacaataataaactaacacggaaccaccattatgattaattttaaacaatttattgcagaatctaactatgacatgattactgaagccggcgagcgtatgactaaactgaagtggcaaagcgctatggatttagttccgccaggtgaacgcgatgacttcatgaaattctctgctgtagtgaaaaaactttatggcattgacactaataacgccaaagaatattaccaggtgcaaaatgcctttaaatctctaagaggcattaaatctccagctaaagcaccaaaagaacctaaagcagctcctgctccaaaagctgctccggcagttaagcctgttgctccggtacaagcaccaaaagctgatcctgctcctaaggttgacaaaggtctgtatgactttaatgtcaaaggaattgtgagtaagtatgagaaaattttagcccttttagacgaaatcgcaaaagaaggagctgttctcaaaactcaatttgctaaggttcgtaaaggccgcaacatcagtaacattgacactccagaattgatgaatttgtacacttcagttgaaactgtagcttacacttcatctcttagaaaagaggttcgtgattacatgtctactgccaagcgcgttgttgatgacgctaaagttcttcaaaagaaagaatctaagtaagacttaatgccctgggtatctctatgacactcagggcatttttgtatgtgtagtcaatggtttaatcattcccttctaaaagtttctctcaaccgttctggtgaatcaaaaatctctctttaaaaatttttcacttgccgtttacatccgtagaagagtgtgttagtatagctctaccaaaacaaaacggagcaaaaaatgtttaatatcatcacagaaaaacttactaagaacggtcattcagatttagcaaattctttgaatgacatcaaaagcattaagcaatttgtatgggatacttatcgttatgctgctttaggtaatgacgatggacgttggtttactatcgtgatcgctcgtgattctcttaacactttcaatgtgcgtccggttgctttaactaagacgtaccacaaagacgacgaagcagctgaaaaatatttcaacagaatgaaataaaattgtttacaatggtgaggtagtatgatattattacctcatcaaaacaaaattgaatcggagaataaaatcatggctaaattcaacacagtaactattcatgaagtaacagatgatttcggtcgctttgagaagtttcgtgctgtacttaacagaggcgaacatgagcaccacataactaatatcgtagaaagtaagaaaatggctgatattgttgaatatgttaacgcacattggtgcactgctgaagttatcttcggtgataaaatttaaggagtgaaaatgcactatcctgataaagcaagagctgctgctcaaacgtatttcagttcgttctatcggctgtttggtaaaactccaaactttccgtctggcgaagagcagcaagctgctcttgatacaataactcgtattattgcagatggtatgcaaaagtacggtagcgacccagcagtaatgcgcatcattgattgtgatgtgttggataagatggaagaactcatcaattcatatgagtaatgctttaaaaatttgatttaaaataactctactttaaactgaaaggaaataaacatggctattctgaagaaaattgttgaattcatccgcatcaaactgggcaccttcatgaccaagaacacttcggtcgaagaccagatgacacatgctgctgagcagattatctccgaagttcacaaactgaaaactcgtcatgtgaccgctactcgcgaaatcaatgacaaaactaaagctgctgcagaaaaagatgcacaggctgaaagtaaagaaaaagaaattcgccgaattctggctgaaaatcctaacgctgatgtacagacccatgctaaacttggtcttctgtatcgtcgtaccgcagaagctctgcgcaataaagcagctgaactgaaacagatgctcactgaaattgaaactactgttgtagctctggacgaccagcgcgaagaccttaaagttaagctcgagtatatccgtgaaactcgtgccgccaactccatgggtctggacaacgtagcagatatcatcgaatctgcatctctgatgaaagttgatgtacagactaccctgtctcgtattgatacattcaacaccactccggtcggtattgaaaccaccaccgctgacctccaggaatatctggaaagtctgaaaggctaagaaatacaccggggagaaatccccggttttcgggataataagaggagaacattatggctttttatgatgattttcatgaaccaaagaagaaagattccggagacacaaaagtttctactggaaataagtttgggaaatatgttcgtggccaattagaatattctggtatgccaaagcgcttaatcaatatcattgaacctctggctccaccatacgatgattattctttacgtatggatgaccatcaacttaaagaacgaaaagttccaggtcacgtttacatcaacagcctgaaagatgttcgtcgtattctttctgctttaattgccgatggatgcagtatcgcttataaaggcgcatattcgtatcattattcatcaatttcgttgaataacttgacttctgaagttcgtaaagaagacgaaggaactcgttattcaatgggtcattggttctgtggagctattgaagttcactacaatactcgtggtggaaagtttattttctcatttattgctgataataatcttgaagaagctcaatcattccgtggcccatcacgagaatatcttgttaagcatttttcagctgaaatgaataatcttgtagaaaaactacaggttcctggaagccatatcggagcggacgtttccgatttcattaactactgccgtgggcagattgcaaagagaacaagaaatgaacaaagtaattcagattgaaattcctgaatataacgaccgtaaatctgctgcagcagmtwtaccaaaacttctggagcagatttacnnnnnnnnnnnnnnnnnnnnnnnnnnnnnnnnnnnnnnnnnnnnnnnnnnnnnnnnnnnnnnnnnnnnnnnctgctgaagttatcgctgatgagcattgtttgacttttgatgtaggtgattatggaaacggccgttcttactacgtaatgaaaattaaatcaaatcttccaacatctagatatagaaatgacgttttacggtttgtgcatccagttggatttggatttattggaattactccaaatccaactggatgcacaaac

SEQ ID NO: 19 - DNA, 172775 bp, Unknown
  bacteriophage genomic DNA
tagcatcgaatacttggcggtcaaattccggaagaatacattccgaaattgattgtggacgatatttctgttcgaagatgtgttctttttcgttaatgcttaacataatttcctcatattgaattaatcaaatcagtggatggtccgaagaccatcctatcacaattagaaatcgtgagtactatctgcttccattgctactacataacttgcatgttcaccttcgaacttagcagcagttttcttaccttgtgcccagagcagcagtttataatcggcaggctgcatcttcatgttacccatgttgataacgaagttgaagttattcgtaccatcataatcaccgagagtcagagaatatttggtacgaacaagtgcagaatcttctaccttattgaagccgttcagaacaatcttaccatctttattagtgatggtgattgtgtcaatctgcagaccgcgagatactcgcatcagctgttgaaggtcttcagatttgaagtcaacgataacagaagcaaccgggaatggaattggtttgcttgggaatacgatagtgcttgggtcagctgccggccagaaaattgttgaacgagcatcagcaattttgatgttaccgtcatcagccagagaaatttctgcatcttcattaaccagagacagaataccaaggaagccgttcagttcataaatcgcaacttcaaaatcaatttcgtcagcgatagttgcttcagcgtaagttgtaccattaactgcacgagtcatgatgaacttaccaggtttcagcataataccagagttgatggtagagaagtttttcagaatattcagagtatctttagacagtttcatgtttttccttagttcaattcaatttcagtttcagatgattcagattttacaacaaatggagcgaagctatcataaacttcttgagcaacgatttcagcagctaccaacagctgttcatcagcgttagtacagaattcgtcttccaggcgttcaccaccgaccttatcaagaataactttagcaccagctttaattgaacggtcataatgtttacgcataatttcaatccacttctcagagactgaattatcaacggaagagtaataagcaaaacgaacttctgcatctggcagtttgcgtttaatagcttctttaatttcttcaggcagcatcagaacccatgctcgacggattttgttctgattgtttgggttggagtcagtacgtacgtttttaggttggatttctttaacatcagtaacgatattcagcatattattttctcattcaaaaaattcagaaactgtccaagcaggatgtctgttggaagatattttatcatagtcgttaccgaaagcatcttttaaatgctggtcggtaacgacgtgttcttcaccagaaaaattattgatgagaacatacttctttatttcagggaacgttaataactcgttcccggttgcgtattgtttcattccagtaccgtaaagcgaccaattttcttcatttgaagatgttggccgtatgcttgagggtcatggtcacgatggctgatgatgaagatatttgaatcttgcatcttgttgagtatttgcgtgatagattttacaccgtcaacgtccgtagcagaatcgaatacttcgtctaagaacaaacagttaatcttaacaccagatactaattcagctatatcacgccaagtgaataacagcgcaatatcaatacgtgccttttcaccctgactaaaagagttgtaactaaattcttcgcgaccgcgagatttgatagtttcattgaactcttcgttcaaagtaaagacataatcagcatccattactttcaaataagaattaatttgcttattgaacaacggaatgtacttcttaattattaagcctttaataccagaatccttgaacatctcagtaagaataccgcgaagatatttttccataactgagttggatttggtatcaactattttattcaattcttcattaagcgttttgatttcatctgaataatcgatgaactcttcagctgctttgtcaatagctgctttaattttacgaatacgctcaacagctgctttcaactcttcagttttggctgctacctggcctctgatgtctcttactcgacgtttgaccgcttcatattccatctgggatgcttgaagattctctagatgcgtttttaactcagcgtgtttgatattacattcatcaactttcgagttaatctggccgattagagtgtcactggagtgcaaatcctgcaaacatgttgggcaatgaccgcctttatcatacaacgacagaacttttgtgtatgactcgatgcggttcaggatggttatcccagccatttgagttttctgaattccttcagacacatcgtcttcttcactgattacgatattagccaagttcttgttcaactcatcaatagcagaacgaatattacgagcatcagccatagactcttcatacatgctctgccagcgagcaacgttttcaccagaaagtttcttttgcttctctatgttttcttcatagattttgatttgttgctgaattccgtctttctttgcatcaagaacttgaacttgagaattcagttctcgaaccaaagacttattcagtttatccatttcagcaataattgaaacttcaagcaagtcttctactaactttctccgagcgggtgtactaagacccataaacggagtgtagcctgctgttccgagtaccacgacttgcttgaaactcgtgtatgacattccaatgagttcttcgaaataactttggaagtctttaactgaagctgcttcatcaagtttagcaccgtcgcgttcaatttcaaagacatttggtttctgtccacgtttgatgtaatacgaatgaccgtcatattccatccacaattcgcagagcaatcctttcttattggtggaattaattaattggcctttcttgaaatcacggaatggcttaccaaacaatgcaaatgtaattgcttcaagcattgtacttttaccggcgccattcttgccagtgattaatgttttgtggaccttgtcaagttgaatatcaatgggctgtccgcccactgacataatattttgatatttgactcggttcaatttgaaaatcttcattgattctgagcctcaacataaagagcttgtgcaaattttttcaatgcaacgttatcagttggagataagtcttccaatgcatcaatatattctgacatcaaatctaataagcttttaacttcgatatcttcttcgtcatcagattcaactgagtcgtcaatcttagaaaccatacgaagctcgtgaactactttttcaagttcagtttcaaacttcgtgatgtctttatcaacatcagtgacaattactcggactgaaagatttttgtagtcgttgtaatcaatcttacctgtgaatggatattgaagtcttacatgccaagtggtttcgtttggcacaaaatccatactttccgttgcggtatcgaaaatccagaatccgcgagggtcgttctcgtcacctgctgtaagggtccagggagtgccgatatacttaacattggcagcagaggatatagtatggaaatgccctgaccacacttgcttatatgacttaaggaaatccggctcgagaccatgagattttaaacccttgtagtaatagaagccattcagctcccagtggccaatacaatactctgcagatgattctttaacatgcttcataatagaagctacgttttcgtcacaaagccatggaattaggtcgattaagcatccatcaaaatcaacagtagtaggcacatcataaattttgatgtggtcatgtttgcccaatacttctgtaatagcgttaggatgaattttattcttataatgcatatcgtggtttccgatgattgtatgcatcgtaatcccagcttctgctagcatatcaactatttcacgagcgaattccatcgtcttgtgagtaatagctttacgtacgtcaaaaatatctccatactgaatccacacggtaattccatgcttcttcgagtactcaattttttgacgaataccatcacgttgaatttcttgaagccaagggtcatcaccctttacgcccagatgccagtcacctgtgtgaagaattttcatttctttttcctcaatttaagacggcgatgtggaagttttattttaatcgcagatgtatgttctcttttacctgatatttgaatccagttaattttcatatttcacctcaaagagattatattctatactccagaaagcagaaagggcccgaaggccctttaaattttactgtatgtgatagttacttcggcttttgctttatcatatgacatcttgaactgcctcatcatttcagtcttgccgttatgaatctttgcataatcaatagctctttctaaagcttcagccgaataaacagttccgttgcgggatactacagcagcttttaatattacagcttccaccatggcttcaccataattgtatcagcccagactaattcctttttagtagctttaactactggattgataggaccggtttcacccaagactttgtaatgggtttcagatactttaatagccattacaccatcagcaacagacaaagtgaaacctgcgtttactttcagacgtttgaatttaacctgctttatagccatttaaaatttcccagatctgacgacgagtggtttcccattggactttgataagctcgtcattgaatggttgacgtaagattttacgagatttttcaatcgcatacttatacgccgcgaagttgttatcgagaactgattgctgagcatgtttgttcaaacgttcaagttcgcgactatttttcttgataattttatcagctttagatttagcatttgctgcaattcgagcttgtgcttcttcaatagctgcaagacgatcttcttccattaatttctgatggtctggatcttcaatcaactggtcttgatattcaagttctgctttgaatgcttcgcctggttgtagcataattcctcattctggaaagtattctaatgtgatataaaaatcatcatcagatatatggtaattgtagttcaagtctttgccatcgcacttgaactctgtatcatgtggatctttggggtcaatgtgaatgtccatttcgagaacttccctcatatacattttaagcaaataagggatagcatcataatcgggcacttcttctaaaaatcctgcgaggttaatcgtcagcctcatataaaaaatccaaacttggaccttcatctacaacatcgctctttttgtcagaccctggctgtttgtaggtggaggtttcgtaatgcgtcattttatcatagatgtcttgaataaaagtttcatctactaacgcaaccatatcatcgtcacgagcatcatagacgttgtgaacgaaatagctatacttcttagcaacttccttacgctctttcttaatgcgctggacgaatgcgttaaagcaagcacgggttatatacgcatgcgggttgtcatactttgtttcatcgaagttgtgtagacctttaatcgaagcttctacaccgtctgaaatcatttcatctttccaagagcgggtgtaccctgaaaagttaaaacgcttactcagaccctcagatatcaacataattgctctgccgatagtatcattctgacgaacgggtttaccagcttcgcggcattgctgtttccactcagtgatggctttcagcaactccttattatttacatagttagccatattacctcttccgcttcatttaataagaatattataacacgtttggaggaagggtattttaagcatctatttaaggagttcgtaaagcgtaaagcacttaatcatgagtttgcggaaagtaagaaaatcgagttcaggctcaaaaacattttcattacagaatctgagccatgatttccataattcgatatagccattttcattcagcttagatacatggcctcgccagacatattcaagactaggaccaggttcatttgagtctgagaatgtaattcccatccacttatctacgaaaaattcacccaatccagtaacacggaatgaggcgatttcaatattatctaaagtaattcggctcataagtcaaataccttaaaagtatcttcgattaaagtcttaaacgtattgtagtgcataggttcaaggtcttcgcaagtttcttcacaaaattcgcgataaagaatatctggagtgtaatcgcggaaaatagcaatatcagattcccagtaagcaccagtttcttcatcagagaaataaacggtaccatcacgacgaataacccaatcgccgtagttcagtactgtgatagtgaattgattatatttcatagaataagctccttggcgcattcaatagcttcatccatacttccgaatgcatctactgagtgatagtctttcccagtgtattcataaacccaccaggcgtcaaaatcttcttcaataacgaaatcaacatcgttctttgaagtaccttcaatcattaggcggccgtcttcagtacgctttgtttgaaatccggctagctgcaagtcactttcaattttattcatttggcagccttaacaatcttgaggtcaacgaagcctttcttgcgctgattcttcatcttacggatagtgctgtcagagatttctttgcgcttggtagttggaataccgaaagcatcaaggctaaattcggacagaatgtaagcaacgaccagttcacggatacgagctttaccaattttctggtcgttttctttcatcgtaccatgcaactcaacttcccacttatccaacaacttaggagtcacgataacgtctttgaactcaccatcaactttcattgcttccaccttcgggaatacgaaagcgttcagtacgtttttgatagcctgtgacatattgatttcctcatttttaactaagtttgacataagagattctattctgaatcccttatagcaaaattaattaatgttgttgtaaatgtctttagtaagagctgcagcttcttctttttcaataccagacactaaagcatagatagcgttagtgattgaacttggacgatgtaaagctgttgtaacttctacttctgtcatcactgaacgagcgcgtagaacaatttgttcattgtcaatttcaacttttactcgtgtactaccgcaagcagtacaaactgaatactcaatatgaacggaagttgtctttgatatagtaaacatcttaatctcctcggttagtgtaagagtatagtaacacctttcacagcagatgtaaacggtctatagaaataaaaatggggaccactagggtccccgaagatgtgagccatatgtttatatggacttcaaaagaaagtgtcttagagttaatccagtgaatcgaggtcgtaacctagttcaccaagtctctcttttattgttcttagatttgggtaatatacaccaccgaggatgacgaccgggtaattgactcgcttgcttgggaaaactcctgaggctttagcggcttcttcaatcgccttgtagttgtattggacgtcaccggccatgtagataacgtcgatgaactcatacggaattttgaattcgtcaaaaatttctttgactgctgcgcaaccagcgcagcgatagacgtcttccggaattccataaattttagctcttagttgtgagttttccattgactgtaacctcaagcttatcatctaaaccaatatccttaagcgcatcagtcattcgacgaatacgagcagtaacttcttcgggagaaagtttaggtttatcatcggtcttaggagcgataatcactgccagtccgaataccaaaagtgcaggtacagcaacaataattccgtaagcaataacaagataagcaagaagcttagataaagcagttcgtgttccgttgaagaaagatttgatgtatttcatgtttttccttaggagaaagttacgataccagcgaaaacgtacagagcagggaattcttcgccccagctttgaatgatgaagtttgcgtttagtgcgagtttattcaggatgttcattgtgttcctcattccaagttccgctgttaatccacagcctttgattgtcactgcctctccaaagctttttagttggtagagactgttcatatttaccatcgataataacatcaacataatttagcagttccaagtccttgatatcttcgaacttgtagcccgtccacatccaaacatctttatgagggtgactagtatgtaagcacttaagcagtgcttctatagtttctctattgtctggataaagagggtctccaccagtaatagtgattccttgaatgtaatcaggctcaagaagctctctgatttcaccaatcgtttcaccggtgaactctgttccattgcgtggattccatgtagacttattgtaacatccttcgcatttatgcaaacacccggtgacaaaaagaacgaccctgcaaccagggccattcacaaaatcacaaggatagattctgtcatacttcacagtgctttgtcctatgcattatttctttgtttttaccaagattaaatccacgttcagatggatttccaagatatccacaagtgcgtcgtattgtgttcatctttttagggtctgattcaccacattcatgacagacaaatccatcttccgttggagtcatttcatgagttgaaccacatgtaaagcacttatcaactggcatgtttacaccgaagtaatcaagatgctcaacagcataatcccacactgcttcaagacctttaaggttgttcttcatatcaggaagttctacataactgatatgaccacccttagcgatgaagtggaaaatagcttcacggtcaattttaccaaatggagaaatcttttcttctactgaaacatggaagctgttggtgtaccaccctttatcagtgacgcctttgatatcaccatggacttcagcatcaatcttacagaagcgataacacaggttctctgctggagttgaataaagactaaaagcaaagccagtctctttagtccattcagcaagataatcattcaagcatttcagaagaagcttaccgatatcagcacccaatagagtttgaacttcatggattccgatgtaccctaacgaaattgaagaacgaccatttcggaagatgtcgagaatctcatcgtttggcttaagacgaacaccaaaagcaccttcttgataaagaataggagctacagaagctgttacaccgcgaagtgattcaatacgagctaaaagagcttctttacaaatcttcaaacggtcatcaagaatgtggaagaacttggtcaagtctggacggccatcaaccatacaatcgagtgctactcgtggtaggttaattgtcactacaccaagattattacgaccatctagaatttcttcaccatctttgttcttccatacgcccaggaatgagcgacatcccattggagaaactggaacagaagagccagtgattagacggttattctttgaactaatgatgtcaggatacattcgcttacttgcacattccaatgcaagttgtttgatgtcatagttcacatcagtaggatgaaggttaattccttcttcaacaaacataacgagcttaggaaaaatcggagtgattccgtctcgtccaagacctttgattctatttttgagaatagctttttgaatcattcgttcataatcgcttgtaccggtaccaaaggtaattgccacgaatggagtttgtccatttgaactgaacaaagtattgacttcatattcataagcttggaatgcgtcgtatacgtctttttctgttttctcaatcgcgtatacatagtcattgacatgctcaatgccgtatctttctgcatcgtgtaaatgtttaaagaaagtcttctctacaaaaggagcaagtacaacatcaacattagcaaatgtcgttccaccatattgatgtgaagctacttgagcagtgatttgagccataatagcagttgctacaccaattgactttggagtctcaatttgagcattaccaagtttaaatccattgctgagcatacccttcaaatcgactaagcaacagttagtgaatggaagagccggagaatagtctaagtcatgaaaatgaataagtcctttatcatgagcatttagaacagtaggagagataacttgacgagcaatatgttttgaaacaattcctgccatcaaatcacgttgagttggaaaaacacgagaatctttattagcattctcgttgagtaagtctttgttagtgcggttgattaaaccctggatttctgattcaattgtcattttaaactcttacgaagttgctttttgaatgaagcaacaagctttggtttggaatcatcttcagaataggtaaacccgtaagcattcatttcagctatcatctcgggtttaccaagtcgactgaattcttttgacttatcgccaatgaaattaggatgaatgttgtttttagtatagtcattcttcagataggccagcaaactctcaagccactcgaggtagtcgacttcacgacctttcaaaccagagcggttgaacttatgcttcatttgaccttctgctgcgttacacagattacatagtaaaccacgaactttaccggcttttggtccgttcaattcgtggtcgtggtcaaggtggttactttgaacatcgctgtctaattcgcgtttacaaatcggacagataccatgctgtgcatcaaatagtctttgtttttcttctttgtagagtttgctggtcaataacatagttcacctcaatattagatgaactatttatagtttagaacttcctggagttaaactccacttgagattcaagccaacgaatataatctgcagcagcttgcatcaaatcgtattcttctgaatcacaattttcttgaccagccattttatagagctgcgcagtaatatcttttccgttaaaaagattacgagggatatcttcagaagagccgtattggtcagaagaaagttcttcaagttcttctaaatgatcaatttcatcagagtagaagcaccagaaccatgaatcttgtcctttaatttctggatgagtagcagttttaacatgaacataagggccgttcttaaattgaacagaagtcatgccagttgattcgcctactttactgatgctcagaactttaaattccgcaccctttacaaattcagggaattgagaaagcagctcttcatcttcttcaataacacgaaaaactttattcaggaaactcatatccaaactccatatcgattaattcattgttggtaggttcattataatcatcttcaggaaagcgttcttcttcctctggctcgagagtttcccatcgagccgcataccaaggttttagagcgtaacccattctgtgatagtcttagttactttacgctcgcgtttctcgactaacgagacatcaggctccatatagtaccaatcagtatgatacgaaccagaacgagtttcatttacagcgacgtgaacgtcatgtttcttgctgtagtaaactacttgacgatattgatacttgtgattctgagtccattcatcatggtctacttcttcaagataatcagagtcttcaaaatcataattctctgaataaccatcatggtcttccatgatttctttcagaatcttttctttcatttcagaaatcattattcacctcgtaaagtttcaagaacttcatcatcaacccaagattctaaaccacttggaagagaacgctcaacttcccaaagcaaagcttcacattcgcgaagacgagcaagctcagcagagcaaattacttcttctttctttgggtcaatcaatacagagttcagactcatttcaaatattccttcaattcagtaaatccaccgataggagaacctttttcatcaaaaatctggggcattgtcagaccaacacgagatggtctattcagacgcaccagaagctcagagataacttcttcattaaagattggagtaccatcagcttcattacctgaagtcacagagatgaactcgtaatctttacgtttagcatctaacagacgcttagagttaatgcatggaacacatttaaaatgcttgttgtcgtaaccgaaaaccttgaatgtcactagagatgtcctcaataactgatgagactactttatcgtagtcgggatgattttgtgtgcgatggtcccatttaacaccaagacgttttgcaacttcacggttaattgagccaaacgcaaatgaatgagcacgggttaaagcactcttcaaaactgaataagaatccggcattttaccatggtctttatgataagctaccatcattcggaggaggctgtcttcggcctcaatcatatattctttacggctcatagttcttttaatttcttataagattcgtgagcagcaattgctttgtcaagcatagcaccaaagtgattattgatacgagttgtcattttaattccttcacaaatttatggaaacagattcggcatttcatctgaagttgaggagtttgccagttaactaattgtacttgaatactatcacattttgggtaaggcgtaacttgtttagctgctgcttcacgtcgttcaaccatttcaatcatagcattccaacgggtagcggccataagccgctccattccttcagtgtcgtctaaaatttcttgacttaagtcaatatcttctgctaattgctttttcatacaccagccttaggttcagagataattcctaacgaaatcttcagagtttccatttgacgtttcaattgaatagtacgagaactaattcgtgaaacttcatcattaagattacgctttttcatttcaagttcattgaactcttcttcaagctcgttgatttttgcttgaattgctttattgatatcaacaggagtttcaatagttttatgtgctttcactggtgtcatggatgtttccactacagtattgtcagttttaggcgtattaaaagttaccgcaattcgatgctgtgatgaagtttcaataatcatattactatgacgaacaactttcattcttgacagagctgcaataatctgtttagaaatacgctgcatatcgccattgtcacgataaccattacgaatggtgataaccattgtatctttacttacttcatcttcagtgaatgaaattgttggtaaaaatgatttatccatcgaaagatggaatttaatttttgctttatcattttcgctcagaaaagctgtacccaaacgaaggatactagaaacatcgttagaaaaccgattaatagcgaacttaataccgcctttagtatacgcatgagttctatcaccagcaacattgtaatacatttcaatccagccgtcattaaattcgtcatcggctttggtcaagtaatggctcaaacggttatgcgctttaacacgacggagaattccgctgctgcgcagtacatcaatccaggcgtcgggtttgttagcatccccggcagctattcgcgcagcgttgatgcgagcattaattcccattttaacaaattcagtgtttaaaatggttgaaatccactgacgaatacatccaagtttttcaattcggtcagctcgtaatccttcgcctgggacgaagttgaaagacgtttcagcattagcaataagttctttgatgtaagtattgaaattgttattggtcaatacgtttactaatttcatatctattccttcattgtcaggcgtaaatttgattgagaatccgtgaaaccattatacatcacggattcagaaagcattttaaatttttacttttgttggacgcttaaagaacgaatgagtgttgtcatctttagcatgctcaaaagttgcagagaattcaatatctccacgatagtccatcggaactgcttttggtaatgagccataaacagtagcaccgttttcaagacggacagtcattttgacttgcattccataatagtcttcccagcacttaactgaaacgactttacctttcactgtttgcttaccagtgggtgcttcacctttattctttttgaatgattcatacagttcatcaaagaatttcttagaagcttcttgaatagccataagaatgctcttatgagctctgacttcaaccatcataacagtggtgaaatcttcaagttcccaacgtttgtaaggttcacggacctcgatagggcaaccgtaaagcttaagttcaacatacattgctgcagttaaacgaagtttccaccatccatggtctcttgtgtactctggtttgtcaaagtaatcaagttccgtaacgtatggaagataactaccagcgtgatatgcttccacttcgccaagttcattttcccagagataaccatcgaacggagcatgtggacgatcatcaattccccaggttggagcaaccaccttatcaaatccttcacgaccgtagtgggtcttcgcccatccagcattcaattccaaagcgcgttcttcaactttcgctcggcgtgctgcatgtgctttacgattttcatctaagattgagtcgatgatttcagttagcattttgtttctccgttggttgattacgagactatcatatactaactttttagtgttgtaaacggttgaatgcggattcaccagaacggttgagaggaactttcttaggaaggatgataaatcatattacgaggatacaaaaatgccccagcggagccggggcgaactttagtgataagctggagtattagggtcaccagagaaccacacagacttttctataacagctgcttgcaattgattgttataaagagtctcattaataattttttccatctcaaacaaatgtgcagcttgcaactgctcacggtccattgcgattagagctttacatttttctttcatataagcttgtttgccaatctgtcttcctaccaatggtagttcacttcccaatttaagccagttattaaaagcagcatccgtagagtttttatattctactatagaatcagtcatacgattataaaagtctaattttgcttctttgttgttctttcgaagcatttctaaggctgtagatttcaaactcaccgcttccactcctctgttcgacctattcggtccgggtgacaattccagaaatagtccttgcacttatttccattagtgcgacaaaacttttgctggtatgatttctttttaaatggctcaccgcaacttggacatactaatgtagtgccaactttcattaatgcattatttcggtagatgggttccatgatatcatacctggttgttggcttctgccctttagcacttttactactatgctttccttttccatttttgttctgtcgctgagcatcactaagaagtctgaggacttcaattcggtcaccatgcaagttgatgggccgaggctcgtgaccatattcttcattttcatagtcttcgtcttcataatcatcataccaatcgtttagttcatctaatccgtagcccatttatttacctacaattaaaacaccaaccatgaaaataatccagaacggatagaataaaatcatagaccattctgctaaccatttaactactttttgtttagtagtgtgacagcttgatgccggcattccaagacaccaagcgaaagttttaagaaaggcaactccacctagtaaataaaccactattgctaaagcaataagaactggaattaccataaatctttccttagtaaattttcaacatcacttctgtagatggatgaagaagttataagttcatcgtcaaatttcacttcaacctctaacgttccaaataacgaatcattacgaacttctattgttaagttctctttaagcatttcttttagtaatgctcgaatctcttcaggattcataatttcatctcaattcgttctttgcttttaacaccctttccgttatcggagtgtttgcgttcaaaaatgtagtcgtatgggtcatcaatgtccatacgttgccagaatacgccgagttgaatattacctgggtcattagatttagaacctgtgcaacgccctaagtcacgacgagaataacgatgatgaccattttcgtccatgatagtttcataacttgtgcgacggtctgggccaaggtctttaaatttcgtcatcaagactttatcgccagacagagtttcataagtccaaccttcttcaaagtagcttggatttccgtcttttgattgaaccatcacaataacatcttcaatgttctggtcatcattataagtgccaagatgccatacagcttgatattgattctcagcttttactgtcgctactcgaaacttttcgtcccagacaccattaacaaaacgtttgaatttaatttcgtaagtgattaatttgctcattataatttcctcagattaagcctaatgcacgtttttcttcagggttcaatttagataaagcagattgttttactttttctaaacgagcaactcgttctgcttctgtttcagtgcgaatttcaaaaccatctttctttaagaaagaaagtttgcttccgtcttcaaaggtaagtgtcaaagctttgacaggatgccggtcaactgtaccgtttgaaccataccaggatttaccagcgatactctcttcagctttaaagtaagagtcatagtaaccataaacttctgagcggcggtcgtctggtgaaactctggcgacatagacgtctgattcttttacactgattactttcattgtacccattctccattttcgtcgatataattaatccagtttgaaatagtccaagaagaagtatttcctttaggaacatcaacaatatacattccgcttttaaataaaattcgctttacatcattggaaattaaagaagccataatattttcctcaattggggctttcgccccgtggttgattatttcagcatagttacttcagcaatttcagtccagtttttctcgtcagtagcgacgaaatctgccaggtaaagagctgtgcggagagatacattacgaagacgattaacgttgttttgcataaatgccagaacgtcaagtacttggtagtgctttaatccgcggttctgcaacatgtcggttgtcataataacatcttcaacacgagacatgatttcttcatttgtgtgaacaccgaggtccagataaacagaacgagataccaaagcagaaagatgcggagctaatttgctaccacgttctaattctttgtcaatatcaacgttagtgatgaatactacagtaccttcaaattcaaattcgttcggaatatctttttcttccaggaaagcagaagcagttgaccagcaaactttacgtttttcgccagaatcaagtgcagctttcagaaggttcagaatgtccatatcagaaaatacgtccacatcatcaataagcagaacagaatttgaatggcgagattcccaaagacggcagtaaagaccgataccagaaatcttaccattaaccattttgtattcaatatcaccacgagcatctgctttagttaatgctttgtccaaggagaaagtcttaccgataccagcagcacctgagataatcagtgaacgaatgttcccgttaaccagaccagcagtcattaaccccataacgttgaagcgtttagcgatacgagctttcatttcttcaacagattcggtcagaacttctttagttacttgaccttcaattttgtaatcaccgtggaaaacccatactccacgtttcttaccatcaatcattacgaatactttaccatcaccctgagcagcgtcagcttcagataaatcttttgggaaccactgatcaatgaattcaaaagtaccagaaatttctttaccgaagttagtacctttagcgatagtgatggttttcattttgttctccagtgtatcagtttgtttggtatgaggtaatagtatcatcatctcataccgttgtaaacaatttattttaatgtccgccaaatttttactgcttctcgtcgagaaacttctacaactccaagctctacagctttttgacgacggtctgcacgcaagtcatagtgcttaatgcgtttgtcctggaaccaagaacgtttcattccgattgcttctgctactttatgtagctcttcgatatctccatcagtgaacatgtgacaatttttagttggatgaccgcgaagcttccatccgtgattcattagaacatccacgtaaactgtcattggtttttctccaaataagtttcgataattttctgggcgagataaactgcgttatcttcggttgcatcttctaagaagctttcaaaacatgctgaaatttcttctgtgtcaatcaacttctttacttcaatcggtgtagttttcattagctttccaaaatttcgttgatgtagtaaggacgaactgaagaattcaggaagaattcatctacgaagtcaatcagagcatctgaagtaccttccaaaacgatgtaatacttttctgaaatttgcttttcagaagtgatttcaactttatactcctgtgctactgctttagcttgagcgatatttttaactacgatttctaaagttttcattttgttctccagtgtatcagtttgtttggtatgaggtaatagtatcaaactttaaaccatctgtaaacactttttgaaaactttcttcaaaaacaacaaaacctcccgaaggaggttattttgagtgtttttctagctggcgttcagcaaacagctttggctgcattaacaaccaacttaagatacgccagatgacttgtatgacaccgacaggcaaccataatataatactaaacaagtaattaaaaggtgtctctatgtaccctcgtttaacgagagcgtttgtgatgagccacccggcggctagataaaccaatgcaataaagacgggcataatccaccatagttgagccaaaagtaaagtaaccataatcacctgtagtaagagttgtggttcgccagataaacctcttcaaggaactcgtcccagaatgtcatgtcaactttatcaggcataccgtttttagaagcgatgatgctttggcgttcaacttcatctacacagttttctaaccattcttgaacttctttgaatggaatagtgccagctttaactttcttgataaactcagcatctttaagcggataaaccaaatcaccggtggtgtagatttcctggagctgaagaccgccacgaagagcatgagacagagctttccagtctacgccttcgttagcttctgctttacgagcacgttcaccatattcattccacagcttagtgagactgtacttcatttcagcaactgtaatagttgtctggaatttacgaccaagaacattatagaacttctgaacacctgatttgtggtcaacaaaatcagtccactcaaggaactctgaagtcggaagcagatgagcaatatcagcaactttccaacgaacattgtgagctttatcctttggacggtcttcatatttccattccggataaggctctaatacttcaagaactttacgaagttcagctaaacgagaacccttaacaccatacttagctgcttgcttacgaacataaccaagataagctttcatatcggtggtgtagaaacgccagcggttatcttgaatgaatttccatacttcaggaagttcagacttaacgaccatatttgcaggagtatgaagcatgtcaagcgcgacagtttcaccagtagctgctaattgcaggaagtacttcaaagaatagagttcatggtcaacatcatcatgggagttctttgttgatgtgttgtttgtgttcaagttggtgtgattcattgcacgaccaagaagaatttccttcggatgaggaacgaagatttctttgaagtccgtgtcactttctggtgttgacgtaccataaagatggctaccgaagtagcctttcataattgttttcatagataaatgtgttgtcctttggcaaattttactagctcattggtaattttaacacattgttcaacgtgttctttatcttcgcttttctttgaagttctattaatatttccaactttctgttgagaataatagtatttcacttcatgcgtatgatattcttggccatctggatgttgttcccgttgaacatgctcttttagcacagtttcatatagtggaactaatgcccaatcacttccggtattaatgattgccacttgaatgttaatcttattccacttaaaagcattaacatatccaaggaccctttgagaagggtccatcatagcaaattttattccggaaatagaagccattggcatttgttttagcaatgacatactaagttttttcttagtagttacaacttctatttcaatcatttagtcggaccccatgtgaattgaccaccgaaagccgcaatcaatgaagtgtcattcagattaactggcagaccgtcgccgctttcggattcgaggaacattgtaccaccatttttagtgatagcaattacagtgaattctttagaacccttttggaagacatcaccaacaactaccggaatatttttaaaaccagaagcttccgcttcatatgtttctgtgtatcggccgtcttttggtctgaaattagtgaaatcaaccaggtacttattacgaattgaagttacatacacattagtaacgccgtatgatgtaattttatcttcatcataaatgaagagttcaatcattacacgagttgaatatacttttaaaacagctcgttgatttttattgattttaaggaaaatatgagttgctccttggcaacggctaataaaatcaatttcaccatcaaattctgttgttcctgattgaacagtaattgagcgtccaacttcaagttctttctttacaatgcctttagctttcacttgacgaataaacataatattttcctataagaagcgccatgagccattacgatatgcaactgaacggtccatcatttcggaagatgtagaacttccgctgagtttgtcatgaactactgtaattttgcgtccgtcggcaaaaataaattcggctactggacgcaggccagtaaagcctttgtccacagttgcattaaatttagcagattcaccgttgataatatagttctggtcttgtttaagcattatttaaattccagagttgggcagaacttctctttgcgagctttaatgaaagcaataatgatattaggttgtggttcaacgtaagtaccatttctgatagcttcccattttttatcttctttcttttcttttcgtctttgaacgactcgataaattccgtaaccaatacagaaaattgtaccaaaaatagcggccagaataagccaaccaacaatcagtccaggaataattgctgcagcagaagacagaactacaccacacttagcaaataaccatgtagctacatcaacaccagaaccccaaccagcgaagcacacagcgaatacagcaaatgccagaaggaatgtgtgccatacacctttccaaaaatatggacacagagaacgtggagcgctttcagcgccattcatagtaacgagtttgtagtgccaagagttagtattgatttgcattataatttcctttcaattcagttatttaaagtttttagaagtggtcatatgaggtattgtaacctgcagccatgaaagcaatttctcagcttcttctttaagaagctcaacttcttcgccttgggaaataattgtgagaatatctttatcggcattaacgaagagcattgttttaatatcagcatgcccaccataaactgattcagctttatagttgatagtagcatctaaccctgggacgttccaatctaaagtgcacttagtcatttacttgttccttacgagctcgttctttaagttgctcttgaattttgagcattgtttctgtatattcttctgaattagctcttactatactagaagaatatggaagcgattcatgatatttcaaaaatctctcaagatgcggtttgtattgagtagagaaattgtacatcaaaaatcccgtagcacttacgtgagtacaaatttcatactgaaatgttccgtcatattgacgagtaacaataatatcttttaactcaagacttaggctcattgacttctcctgcataaagtttaagaatgaaaaacgctacctttaaagcctcttctttacttaaacgaagaggagagccggcataacatgctccttcagggacagcatgctccaaaacaatttcatcttctttagtgcgaatgtctaaacttcctagatgaaattgttcatatccccaagggtctttcattgcatctcctgaatagcttttaagaagttatcaagattctctttaccgcaaaaagatacacagccatagcttccatcttttgcttcaaaagtaaatgaatcatcaccataatcagtgtaatcaatattagggcattgattacattcaatcagatgtgctttgtccagacgaaaatggattttgaacaaatcttcatcaccttcatgaccaagtttgcaaaagtttccacgtacttcaagaaccagaggaccatgtactgaaccgctttcaaatgtatatttcataatcacctcaattgcgaatcttttgaaccgcgtctgttgtaagacgctttaatgatagtgtcatgtgagctttggcaagctacacatcgtgtgcatcctttttgagctttgcgtctagcttccggaatttctccgtcacaatcttcacagtatttttcactctcacgattttgagatttgatgagctctaaacgagcccattcaattccatcacttactgtagcttcaatagctgcaaatccgtcgtcacttggaccccatccacttgccattacaaactcctttgaacgaggtccattataccattaactaagttgtatgtaaacaacggattgtggtattgaacaaacagataaagcagtacaaataccgttctcattaccaacctgccgtgtcaaattcaccatcatcgtagatgtcccaagccatacgttcttccagaactcggactggtgtccaatagtccgcatattcctggtcttctggagaagagaatttatctgctttaagttcagccataaattccaaagcggattcaacatcaccgaacagacggttcaagttgtgaggtttacgttcagggtcttcaaatactgcgttatcacccgggcaaatttgagtacgataggaacgctttgtttcgccgttgatgtcagtatactcgcagatgatatcaaccatcaagatatctgatgttgggctacgatatggtttactgaggataatgtacttgctaacttcatccagcgacacagtagtttcagtacgagatacaccgtacacgtgatacatgatgcggcctggaacgaaatcagataatttagtaatgcgattcatgatgttctcctcttgtttgtgtaaggtcatagtatcaccttttgaagaggatgtaaacggttcctttaaaacaacaaaagccctgaccaaaaagtcagggctcaaattattccaaagacagcaagtatttggtttgaaacactataccattgatttcgtcaattgtgtttctgattgctccaggcatcttatcgtagatgctttcagcttttgccgtgatgctatcgagcatctcaatcgtgtcagtaggcaaatcctgttgcgatggtatagatggagtgtactttttaccggaccatccaagccattgctctccgaacttgtcggttaactcagggattgcgtcaaagaagaaattgtatgctttgtgacgagcatagcttttagtttcaaaatgagctgagtggaaatatgacgcagaagccatcaaaagaccaatgaactcatcctctggaagtttctttccggttgttatgaaatcttcaaatttcgttttcaagtttaaccttcgttagagaaacatattgcttaccagcatgaactccttcttcagtgcactgggtagtacaacttgaagctgcccatttctgtttaatgaaagaaaagaaacgttcagattcttctttagaaggttctttgaacttgctatatactgccatagcaccatcagcgtattgttcaaagtttgcttcttctgccgatacgggcgagattaaagtggctgcaaataaaatagcagccaatgcgcgtagagtcataaaagcctcagcgttgtcctgtattaagtttgcgctgaagaacagccttaactttatcgaggtatttttgcagctggcgtttacgcaaatagtctggacgtgcaccatgctggcgaaactcttcgtttagacttgagatagcgtggccaatctcgcacttaatttcttccagttgagatacaccaagattacgaagttgcttatcgttcaaatgcttcatacatacctcattagttagtaatagtatttataaaggggagcatgctccccaatttaactttagtcccacaacatttggcacagacctttctcatacttacgagcagccttttcgtcccagttatagtccgtatcgtttctcaacgagtgtttgatttccatcttgtgaaatacacgaggaatcggtgaagcatagcgcatccagcgcagagtcttccagaatgaatcacgatgacgctttttcatcatagaagcaagctctaacggtctttccatgttttgtgcaatttgcttatcaacatatttctgttgatgctctttatctttcttagttttgacgtattcggtatatcgtttgatataagcgaattcgttgttcttctggtcgtgccatttagaagaagtggttacgtgccagcctttacgacgaatagttcttgacatatctacctcttgagttaaagtacctcaatggtagtaaaatcctgctttaaaatatttcatggtgatactttcccttcaattaaaatctttaagaatccaagtaaagctgctatgataaatcctgcggcaggaaaagcgaataaccaaaataatacttcaatagtcatcctaatgttaccttacatttgcattttgggcattcaacttcttttacacgaagacgctttgtcttcgtacgaggagcggtatcatggtcataaacatgaagacaacgataacagatgactaatttcatcagtagatagcctcgaagatttttacactattcataaataccagtcatttcacaccaatgttttcggcaaagtgagacgtatttgtcttcaccacctaattcaatagtatcaccttctacgatagcatttccttcttggtcaacacgagcaaccattgttgctttacgaccacagtggcaaacacccttcagttcacagagtttatctgcagtcgccagaagagcagcagagcccttaaataggttaccacggaaatctgtacgaagtccataggccatcactggagtgttatagaggtcaacaatctgacataactgaagtacatgagactgagtcaagaattgagcttcatcaacaaacacacaatgaatatctttttgagtctgtgcccatttgaagaactcaagaatgtccatgtcttcagtgatggtatttgcttcagcgtgtagaccaacacgagatacaacttcatttgctgaatctcgtgtgtcaatagccggtttaagaatgagtgttcccattccacgctctttatagttatgagctgctgtaagcagagatgctgatttaccagcgttcattgaagcatagttaaaataaagctgagccattactttggttcctcaaattcaatccagtctggggtgttttggaaaattccttcacctacatggttttcacaccctttattagagcaatagttccaatagtcccaatcacacgccatttcatcattacagagcgcaaatactactggccatttacacttcttacaccgcttgtttttatagatgtaagtttgcattattcgccgtcccaatcaactacaataatattaacattcggagtgaacatattaattagtgcttcaattttttcccaatcaccaccagcgatgccagcaccaatacgaggaatataaacatccattttgaacaaagacccagataagaatttgtccattttctgaaaagcattaactaatgcaccataatcaagattaggaccaggctcatattgagtgtaaagattaaagcaagcaccaccatttaatgctaacgctaagctaaaagttccaagctttttatggtcagcataatctgtagctgctttatcagttgacaaaataacaggaaattttgaagaaagttgtcctgctacgcctgcacccatagtatggaaacagttacaaccatgagcaataactttgccttcagaatatagcttaacaatatcgcctttaatgtaatttacaatcatcttttcctcaactcaggtatgcttttaaattgataagtagcgtagttttcgaattcatcgtaaactcgcgcataaatttcttcgccacatgttaaattcttaaaagacttcaaatctttttcagaaaaatctatcgatactccattgatgattccggaggatttggctccgcaacctcgaaaatgaattgaaccacccggaataatagcttggtcttctttgctggagtaattgtaaaatgatacaccaaaagctttctttttcggatagtaagaaacttcaatattctttttaaacgaaccagttgtttcaactagcttaccatcaatagcgtagatattatcaggatagcctgggagtttttcccaggcatttaccgataatggtagagctagcagaaatgctgctattttcacttagataatcccgctatatacaccctcaataacgtgtcacgatattcttcgcaaacattcatatcaggtgcattatcacacaacgactccaggtctttagccttacgagccaccaaggtagaccatttaaagcggctaccagaatcagtttgtccttcagcgtaagttttgtcaaagtcaaatgacaaaatgttcaaacactccgtattagtcttagtgcagaattgctttgctaatgccagggaatcgtcctgctcagtagcaaaatccatcttacacccagatagagcaacaactactagaagtacaaacagctttttcattattccaccgtataatgaagcattttacgagatttcaagtaattcgcctttgctaatacttcagaggcgtacttgttgccggctttccacttgtttcctgcgttgtatgatgctatggcttttctcatatcaccgttatgacggtccaaccaatagctcaattcaatgtacgcccaagaggcggagtgcttccggttctttagcatgcggatgatttcagcgtctgtcattgaccatccggcttgtttaactctttccctaagtgtaggaagataattttgaaatatcccgtaagcttgatgcccatgtttaccagttgtacgtaagcctgcagaactttcctgccagactagtgcagccatgatataaccaagtccattgttatcataccgcttactgggttctttaaacttcccattcttctgaaattgttcaccaaacgaatatgcgtattgcaaattgtcgagttggacattactgaaggtgtgttcggacgcgaatcctagagacgaaactaggagtaacgccgcgcatagagcttttttcatgtttacctcaaattaaagctataacttgataatctttgtgctgattttacctttcaagcgtttatcatttacaaatgccatgcgacattgcatggaatgaccacggaacggatgttctgggtttggtaaagaaacagtcattccaagccatagagtaccatctgtgatttccagacgttgaggtctgtactctacttctgggtcaatttccgatgggtcaattggaagcatcggcatttctaagaactcgtgaatttctgttacatgtttgtgtactttgtggaacagagcgaacacatactcttcatcaatttctcgctggatagcacggtccaggaggtgattagaatatttaataaagaaagctggaataccagcagatgcgcaagcactacgtatagaatcgtttacactcttgaattcagtctcaaagcgacgacgtagcttgtttcggcggatgaatacttctggattagttgtcattttcaatctcctttgttgatagggctatagtatcatagcccttggagaaagtaaatagtcagtagttatggtcatcgtagaacacttgaagcagaacattgctgcgcagcttcttagtgtccgcgatgcgttgacggagcttggagattttgtcctgaacagcattgaaagcgtcagaagtcttagggtcatgaagacccatagactcatccacaagctgctccatcttttcttccatagcattgatagcttcagagaaagattcggagactttgttgcggatagacattagtacttttcttctggttggaatactgaacggcatgcccacatagaagcttctttcaaacgatcaattgcattacgaatctgagtgattctagaatgagctagatcgaattcttcgtcgcttatagtatcaacatccaagtccatgtatacttttacatgctcttcttcaagagctttaaaaatcaagccgagacgaacttcagcatctttaatagcattcactttaccaattttgtcatcagtgtgcggcttgtaacctttgatatcttcaatcattcagctttccttaatttaaaatttgacccgtaggagaaaccattttctgaagaccccacgttttaccataacctgcttcttcagcagatttgtaattgaatggagaaggagattcatccacttcatcttccaattcataatctttacgttcaattgacataaggaatttcctcgtcagtttctttatcgtactcacgaattttgattggttcattaattccataaccacttacagtaagaccagttttagcatcttcccactgcattgttttatcattccacacaccgttagcatgtgcttccattaaatcttgttcgccttggtttgaaaaccagccgcagaaagattcaaccaggtggtcggggatgtcgataataatttgcgccatgttggctccaaagaaatgaccttgcggtcgtaagtaattaagcttgaagttttgatgcctttacaaggaccagagataaactctacttcaaaccatggatgctcattcatcagaccaacatctggcgaagtgcagaggaataatgagcctttaaaaggtccatctaaaaatcgatacagctttggttcaataactgcgccatctgaaaacttgatatgtagaatattaatcaaagactctacattacattttccagtagaacgcaaaaagcgaatatattcaccaattgtcatatcaagggcccgaaggcccttattaaaattttctttcatcattgcattcctatcacaaagaacaatggtaatgcttctttacccggagcgtgagactgagtaatgcaagcataaaatggacctttgaaatgggcttcatagaacttttccatttcagggagtttcattggttcttctataatatacaagattctgttaagcgttcggccacgagcttttgaaccaccgtcaccaaggaaacttctcgtggtgtccatgattatcatgcgtttggcttcttctggatttgcttgatgaatgagttctttctcataacaagctcttattcttttagctgtttcttcggagtttcgttggtgagtgctaataatccagacagttccgccgtcatgcaaccaatccgctgcaaattcagcaacagctttagttttacctgattgacgtccgccatcgatttttagcgtagcatattcacgtagaatatctataggagtgtaatgactttctttgaggatttctatacaatcatcagcacggattttgaatgcgtgcatcagggatagatatggggcaaatagagattttattttcatagagttaccgttagtgagggccatccttggcacgctatagtcctttcgataccacgtgtaaaccccttaccgccgcgggctgaccttattacaggtgggaaaggcccattcttacgagagggttggttcaccttttttttacagccaccgagattggtgggatcctgattgtaactggctttaccgcacttgggctcgaccttttcacaggtaccagaagctacttcactcagaggacacgacgttcatgaggagaggtccaggttggctttttaagagtagatagctactccataatgcttgtaccactcagggcgttgagcaattttatcgtttaaacgttcttgagacaaacgaatagcacggtcagttggaatatagtcattgcaccactcaggcggaatgtcactaatatcaactgttgtgtcttttatattgaaacctcgtttcaaacattcagcaatgatagcttcttgtcgcttacgaagaaattcaagtttgttataaaagaacgttacatgacctgaaccaagaataaagtgttcagaaatcttaaactgccagacctttttaccattcgcaacatgcttacgaacagctccaaaaactcgtggaagctcgcggtattcagcaatgagatgctggtcggctagttcagaaacgagtgtaagattaatgcgagtcatagtgtcctccgttggtttaggaggacatcatatcacaaaatctttaagatgtaaactgttaactaaacgggtcgtgaagcttattaccaatacgacggaacactttagctgcaaatttattggaagggttatcaaccataattttgcgcatgtgaccggtcgcgactgttcgagcagccttataaccagcaatgttatctttcaaagtaattcgaccttttccttagggtcgtcaatggtcactttgtaagttcccatatcttcgccaggcttaatttcttcaatccagatataaccacctggaactcgcttttgttcagctgcttcatttaaaaattcattataggttttcatatgctttccatgttccaactcggaatgtttcaattactcgtttagcacgatttggtgtctgacgataccacttggaattagcaagctcttttgcagctgcttcccattgttttgatttaagcagacgcattgatgctgggaaaccagctacacctgttacgcccatctgaaacaccatattaataagtgcagcacgacgaactccatcaagtacatcatatactggttttaatacagcatttccgagaatccctcgagttgctttatcgacgtctttcgcaaaaatagcttctgcttcagcttttgtgatttgaccattacatggacgccccacaagcttatcaagttctcgtttagcaacatcaagagaagggtcacgtgtcaaaaggtgaccaataccgattgtccaaaaaccttcggtatctttatagattttagaatcgtatccttcatcgatacgaagcatgccaaaaatgtccatgaggacctcctatcagttgataggagtatttatttagcattcccaaagagcatcttgaatgacctttggataaagtttctgcataactgagaaaagacttggacccattactacattccacatgcgtggatgaatcaaagcaaaagcatcaatttccgggaattcatttccgtcttcatctgtatgatatgccgtgcaaatacaatctctgaattgagagtgttccactgggaacggatattcaaagatatgtatatctttattgctagcataatcatggcggcctaggtccactagatgtcctggattatagtcgacgaatccactttcttctcgacactcgcgaacagcagcttcgaggggagattcaccaggttcaatatgaccctttggaatatcccaacgagatgggccaccgcctagtccggaattagttactcgacccatgaatagttctttgtcttttgtaaagaacagaataccagcagagacttctttaattttcttactcaaatttcaccccaactaatttcacgaagtctttgcatgattgactcaacttcttcaatcatatcttcatcgcagtcaaatgaaccttctaccatccaatcactaattggagtgaacatttccaggtccgttgacagacgattacgaatatcatcaactgactcgttatcattaaaagagtacaagtaagaatcagctgattcagattttacaaatactgcaatactcataccttttcctctaagaagtcagacagtttaaaatctttacggtccatcagaccatagtgaatgttcttcagtgtatcgtacatatcccagtacttttcttttagcatattaccaaacggtggaatgtaaagcttatcccatttagcagctaactggccgttgcgcatttctcctggaacattttcaacgatacgtaaaactttaaccgcaacttcataatcggatggaggaatccatccccaattgtgatggactgaaccattgatttcgccattaagcgaagtaaaaattgtagctggacaactcatcgttcacctctaataccttgaatgaaatttaaagcatcttcacctggtggaatttctttaggcttagatttccgtttaaaaagtttccattctcgtttttggtcaaaagttccacgttgaacctgcccaagataaaataaccactttccaatccagtagaatggagttaaaatgccagacatccaaccaacaaaaagtaattgttcaccatacaaaggactaaagaagtacaatccccaatatgttccaaatccataaagcattgtgaacataaagcaaataattattgtacaagcggcccatccgaaattatcatatgaaccagcgtcttggaatccgcgaaataatgttttaatcatcgtttagtcctacattttgaaataaaattctctaaattttgtttgttatcataagcagctttggctttagtaaacaatttaacatgaattttacaataacaccacttaataaaagaagcaacaacaatgacaacgaatagtgaacataatgcgcttagtggtacagagataatcatttcagctacaaatccattgaaccaccaaactacgaaatttgatatgaagacagtaagtataataattgcccaacaaacgtcgtcttcgtatttcgacttgaatctatcttcaatttctcgttcaaaatgtctgatattcattttaggattgtatttcattttttacctcggcattccgtaatgaattcttctgattctcgaattattctattacgaagaactttagcattctgttcagctaaacgtttattttctggtcgcatcacccaccaaattgcgatgtcgttagattttccatgtgaccaaattaaaactggaacagaaataagcattgatgttacaacccaaattggagcataaactccatcatttagtatcaaagctggaataaaaattataagcactattactgaactaaaagctaaaattaccatcatgtgccaaaagtctactttatattcaaattctcttaattcacttcttggttgatatcccatgatcatttcctcgctctacggcaatcgtcaataaagctttcaaaccgttcagctttaccaagctttgacactattctatttcttcgcatgccaattaaggtttgtgcaataaaattaacaaattcgccaatcagcataactatgattgcaaacattccccaaccaaagcatgtgaacgcagccattgctccagcagagtcagctctttcttcttttggaagatttgtgatatcagaccagcccaaaaacaaaataattgcgtatattgacaatcctatgacccagcagagcttttcatttctagtcaaaatatatctgacttttgttgaaagagagtctgtcttagcaattttagctttaagttcatttgaattcattttattttcctcatagggcccgaaggccctttatcatttgaacggacgaatcatatcaaagttttgtttaaagcgtttgacataatctgtctttccaagtttcttatgcattgcaactatcttatggtagttttcccatgcatattcacggaaccatccagatgtaatgctagtacaaactttttccaaagcgtacataaatgaaccagtagggtccgggttgaaattatttggaatttgatgacgttctaaagcaagtacacaagtttcttcatatacacctgcaagcttgagttcttcaggaagagaatcaaatttctcttttgaggtcattacttcggagccatctttcatgtagaaagtataagcaggacgaccagctaaagccactgcttcatgaattgaatcgtggtcatagatgtaaaaatcgtctttgaaaaaagaatctttatctacatccagattaggatgagaatatgctaatgtttctttctgacgcagttcagaaatctttttcagaccatcgtctaaaacaattcctttattacgcaagaaacgaatatggtgcatggtcttttgaaagaaacgagtgttcttcttgaaacgatgagacatcttaattgctaagcacatctcaggagttgcccaatacatctgtgaaagagcgtcatagcaattatgaaacagagcatagtttgcaagcatctcagatgaagtgttttcatcgtattcaaaaatgtatgcttcaaagtaagtctcacgaccgttatgcatgcatttgaaagcttgcacattaggagattgaacttcaacctctgtgccgttcatgcggtttttgaaataaatccattcgcctggagacgcgatgaagtcccaatcagaattcttaacatcactatactcaatgagtccatgatgatgaagtgcccgagaaccaataaccagcaacataatattttcctctttagaatgtagaactactataacacacttgtctggtgttgtaaacggttctttctacacattcgtatgaagccttcaatgggttcttccagttcatttccatatgggcttttcttccaattccagccgccaagtaagtcaaagatttggtcaggaagagggtcccatggatgttctctttcacggagttgaagcacaatatcaccggctgcttctctaattccggtatcgagttttccgttacaaatcacaacatccataagtactgcaagacaacaactatcgtggcttccgtatttgtttggataatagaaataatggtcaataatgtaacagcaattacggtctaaacctttcatagtgttcctccagtgattctggggaaacttttcagtttccccatatattaccattaacagctgctagtgtaccacacagagccgtcctcgttaaccccaaaggtctcagagttgccttcgccataacaatcggaagacatccaatcattaaaggtcagatatccaccagaaacttccatgccgaaagaagcttcacttgccatagtttcaagtttaccaagaagtttagctacttcaactgctacttcttcgatttcttgacgtttttcttcacgagttttagacataatttacccttagcacatatcagaggaagaaagccaaacgccttctacgagtttttcattttcatcaacttctacgccgtcataacctacaagccagtgagcatcataaccaactggatagtaagtacgaccacttccgtaatcaccggtattaaaagttaaacaatgctcatcggcgataatttcagcagcctgctcaacttcttctgctcgttccagaagttttgcaatagctgccgcggcagatttacggtcattgtattcgggaatttcaatctgaatcactttgttcatttcttgttctctttgcaatctgcccacggcagtagttaataaaatcggaaacatctgctccgatatggcttccaggaacctggagtttttctacaagcttattcatttcagctgaaaaatgcttaacaagatattctcgtgaaggaccacggaatgcttgagcctcttcaagaagattgttacaaatgaatgagaaaataaattttccgccgcgagtattgtaatgaacttcaatagctccgcagaaccaatggcccattgaataacgagttccttcatcttctttacgaacttcagaagtcaagttattcaatgaaattgatgagtaatgatatgaatatgcgcctttataagcgatactacatccgtcagcgattaaagcagaaagaatacgacgaacatctttcatactgttgatgtaaacatggcctggaacttttcgttctttgagctgatggtcatccatatgtaaagaataatcatcataaactggagctaaaggttcaatgatattgattaagcgctttggcataccagaatattctaattggccacgaacatatttcccaaacttatttccagtagaaacttttgtatctccagaatctttcttctttggttcattaaaatcatcataaaaagccataatgttctcctcttattatcccgaaaaccggggatttctccccggtgtatttcttagcctttcagactttccagatattcctggaggtcagcggtggtggtttcaataccgaccggagtggtgttgaaggtatcaatacgagacagggtagtctgtacatcaactttcatcagggatgcagattcgatgatatctgctacgttgtccagacccatggagttggcggcacgagtttcacggatgtactcgagtttcactttaaggtcttcgcgctggtcatccagagctacgacggtagtttcaatttcagtaagcatctgtttcagttcagctgctttgttacgcagagcttctgcggtacgacgatacagaagaccaagtttagcgtgggtctgtacgtcagcattaggattttcagccagaattcggcgaatttctttttctttgctttcagcttgtgcatctttttctgcagcagctttggttttgtcattgatttcgcgggtagcggtcacatgacgagttttcagtttgtgaacttcagagataatctgctcggcagcatgtgtcatctggtcttcaaccgaagtgttcttggtcatgaaggtgcccagtttgatgcggatgaattcaacaattttcttcagaatagccatgtttatttcctttcagtttaaagtagagttattttaaatcaaatttttaaagcattactcatatgaattgatgagttcttccattttatctagcacatcgcaatcaataatgcgcattactgccgggtcactgccgtacttttgcataccatctgcaatgatacgagttattgtatcaagagcggccttgcgttcttcacccgatggaaagttcggagttttaccaaacaggcgataaaacgaactaaaatacgtctgggcagcagctcttgctttatcaggataatgcatgttgtgttcctcacataagatgaccaattaccagcttagcagtaggccagttagtaatagaatactcaattacatctttgacatctttagcttcaacaatatcagtcacatgatactcatggtcacctgtattcaggattgcacgataatgagtaacttcaccgaaattgttagtaatttcgtggattgtagaagtattgaaagttgccattttattctccgattcaattttgttttgatagaactataataacacatctagaatcaatgtaaacggcaagtgaaaaatttttaaaaagagattttggattcaccagaacggttgagaggaactttctagaggggaatgattaaaccattgactacacatacaaaaatgccctgagtgtcatagagatatccagggcatttttatgaatcgacagcaccacccactggcagatggtctgcagatgttcattcccagcgactcggaggcatcagtctcgccactggaaatatagcgtcaggaggttatgcttgcgacagggaacaaccgactagcggcaatggacgaaccattctcttctatctgacgactcaacgagggcatacgcaagtttcccttcgaatttggtgccgattgcaggagtcgaacccgcgacatcttcattacaagtgaagcgctctacctactgagctaaaccggcaacttaaagtttaattggcgctcctactaggactcgaacccagactaccgaccttagaacgatcgtgtgctaatccattacactataagagcaattaatttttcaacgaacgtttcattataaacattcgcatagtgaatttcatgtattttccatcctgcattagatattaaatcatgtctttctttgtaatagttatttaatatacctaatttaggatcagaataatgctgatttccattaacttcaattgctatcattttatcaggaatagcaatatctatagaaaaacctctatctttaattggttgatattcttctacaaatgaaatacctaagttaattaagatttctttaagatgctcgcatggctttgatttaaatttatcatttcttttccatgggtgtttttctggattttctaatatccatttcttacgagcattagaaattttaatacattcttcttttggttttattcttcctttagaagctatactcaatttttgtttagtttcatccgatacggtaaaagtataacctaaatttttagcttttacatactgatttaagttaccatttttaattcgggcagaattcattgctgctactgattcttttccgtaattctttcttttcggatttaattcacaccatctagagtgattagccatccagcctttaggtttatcagatatgtcaaattctttatgacaatgtttgcaaatactcattccaatctcctacaatataggagtatttataattggatagagcacaatttggtgcgtcgaacgagactcgaactcgtacgggtttaatcccgggagattttaagtctcctttgtctaccaattccaacatcgacgcaaatatttgttcagacaggattcgaacctgtaagcatgttcttgcggcgttttaccaccatcgtcagcatatgattcaatacgcgaactcaaaaggtgttggaccccttgtctaccaatttcagcactgaacaacgatatttattacatcagaatttgtacggattaataataatctatttctcttgaagcattttacgtaaacgatagagctgattacaaaattccttctcggttaaaacagtttcagaaattttgttcttgcccatgctatgagttaatgttgcgttacgagtagcaatcaatgctttttggaatccagtgttttgagcaagtgcgtcataagctccagttaaaagattctggtatgcttcagatgctcgatgaataggaacacccttccaataaagtgtttgagtaggccaccaacgcttcttcttacctttgaactttgctgcctttccaaccaatgtgcaaacatgagcttgcatttcagggttagaaaatttgagggattgtaagaaaccctccattgaggcacattctacgccgtcataaacgaaagcatgtggcgcaaagttacttaaagcacaagaaggatatgaacttccggagccgatatccatttaattaccgtgcgatattctagaaggcttcttaccaaaataatattcatatgagccatctaaacgacctgctttagtgcggcaatatgaatcccgtttcttataatgccgccattcatcattgtatcttggatgacggtcagcgattaaaatctctaatggccaaccaggcgcaaaggaacggagccgttcgacctttctaatgtatcttttctttaagattttcttcatatagattccgacattacgtgagtagttctctttctgattgtaaattgagttaattcatcaacttcaccacaacgccaagcgtcatcttcagtttcaaaaccaagagcctcgaataagttgcctaaacgccaaccttcgtcaaactcggggtctcctgaaaaatagtaatagtaatcaccagttactaaatcttgaattacaaaatcaaacttttccatcagatacttaccacagtaatagcttcaggagctttaggaataacgatatcttcttcgatgtagaagagcttaaatgtttcagctacacgcatgaagtcaatatcataaccaactggagttccaatcaattcttgaatcttatccatcactttatactgaacttgatagaaatcttcaagacgagcatcaaattcgtcttcagtataatcaccttctgggattacaaagccaagcacttctgaacagaactctggagtgatttcttcattttcaacacaatattcaaagaaagcatcaccagaataatcttcattacccattccattaaggtctgaattatcagatgcaaaacatttagcaacggcacaccaacctgaaacgtgtctagcatttacagcataaatcacattctcttgataatcatcgccatcgttttcccatgatacacatgatactgcataacctttagggatagtttgaccaaagcggagttccataatatttccttcaattaaatggtggaagagatttcttatataaatctatcatcattcgccatttagcaattactttagaatacggagatttatgagagaattgcgaaatgtcagaataatcaagttcaggcagtggagttaaatgacccatcagctcacgaggaaattgatgaaaacaattcatcaaatctttgtaaacataatcaagtaagtctttaacatcaaagaattgggtatttagtccttctttggaataacgatatttcaaaaatttccaatgaccggacttagaatcttgagtaaacgcgtaatcactatgaagcatgatatcgcgaacaaaatcttcagaaaagaagatggagtgagtgcaaccataataaatcataatattttcctcagaatttggtgaccccagcaggactcgaacctgcaacctagcgattatgagtcgcgtgctctaaccaattgagctatagggccaaagtcctcctaagaggaccgagggtattattcaaccatgaaatctgctacttcatcaaagtcattatcaatgacaacagtaaatggcagagcttcatcgcttgttttgatagtcagcttaacaaaaccatcaacagtttcaaccaaaccaacgattttatctgaacgcactacagcacgagctacgtcaacaattttgccagtcattgcaaatgtagcgatttggttaacttcaacaacgatacgtttcattctttttccttagtggttttgatgtagtaataataacatcattattttaaagcataatatctaaacgggttgatgtggaatgataacattgctctgtcattcttttcaggcttatcaacttcagatttcagtttccacccgcagtaaactcgtaagcagaattgaatttttccaattttaagccaaggctgatatccaaatacaccccaagccgattcattccacatgagcagccaaccattagatttaccattagattctacagtaggattacccttccatttaaactctgaagtagcttctcgcccaagaacataataagcaaagttatatgctttatttcgccataaccatgcaacgcgttgcatatattttccaacgaccggaattttacgaatcttttcccagcgcttaatatgaccaccatctccgtcaattggattatcaaatgtcatcatccaattgaatccgtatggaagttttccactaacttcattatagaatggaactacaaatggagcaagcaaaatagctagcgcaccagtaatccaatcaagtggtacaagaacaatataacttaagtattttagcagtttcatagtagtctcctttgacactctatttatgctaaaaagccccgaacagatttctccattcggggcgttattggtgggaagtgttggaatcgaaccaacctctcatgctcttcaggcacgcgctaatccgtctcagctaacttcccttggtctccatgcgaggatttgaacctcggaccctccggtcccaaaccggatgctctaccaaactgagctacacggagtttatttggagcatccagagagaatcgaactctcatctactgggtggaagccagtcataatagccgctatacgatggatgcaatttgtacggaacgcctggattcgaaccaggttaaatcgcgattgacgtcacaatttatcttatgaaggccatgcctctaccatatccgaacgttccgtcaaaaacgctactcggcttacggcttaggcaattcctcgaaccgataatttggcaggccccgtaggaatcgaacccacgtcactgaggttggagctcaggataataccactatacgagagacctaaaatggaggaagcggtgggattcgaacccacggaccgtatcactacggcctccgcatttcaagtgcggtgcaattaaccagactctgccacgcttccgagtttatttttatatgctctatttctcgatttatatgtatcaagttgtgaatcacaattagaacaaacaaatcttaaattttctaatctatggtcattgtttattccattaatatgatcaagaattaatggcattggcttgccgttccatatatcatttataccacaaatagagcattcatatggtaataatttatcttctatcaagcgtcttctaagatgagttctgctataagatgaattttctaccataactttagttaaaggatacctgtcagactttggcccggttttgagtcctttattccaaattttgcatcctttttgagcaccagctccttggcctcttacatattcggctttgtttggattaagtttgcagtatttttcgtgcaaagcttttccgccattatttttgaacgctttatcacaaaattggcatttcattaaaatttcatcgttataatttggctggggtacctggactcgaaccagggaatcgtagaatcaaaatctactgccttaccaacttggctataccccaattgtttggaggcgggtgatggactcgaaccatcgcgtaacgggatatgaacccgtcattctaccaactgaagttaacccgcatctatccggattcttgaagtactaacaagtagcttgatgtagaacacgctaaagatataatcttccgaatatagagcttatcccgtgggaacaaacagcttcgtcctcggcattatcttataggactcaaactcatcttcaagaactgcctcgttattttatgaacttatttatgaatcgtctagcttgagtatgactgactccaagttcatttgcaaattttactaatgcaccacgttttgtgaaatcaatagaattatataaatctattcttaaagcaatttcatctgcagtgaatttatgagcatgattttctgatatttttatttttgtttcatcagaatgattatgtccagtaaaaccagtagatacgattcttccatttgcgccagcgtctttagcattttgcgcattagttgcgcaataaatgttatccaaagaatatggtccaacatctcctttacgacacatacaataattatctgaggctctaccgcgcaaatgatatttgccagtagctttccaccatgatagccattcatcaaatgtcagtttaaattcaatacctcttgatttagcatgcactttttgcatgcggtacttttcataatctttcatattactctcatatttggcagtgctgacgggtttcgaacccgcgatctctcccgtgacaggggagtgtcttgaccatctcgactacagcactataaatttactttcgtgagtatgggattaccctcaagccttccggaaagctgaataggcgttattggctctcatatacccgtgcacagatataatcttcattaacacaataacttcatcaatatactccgaaagtaaactttcggcgccccgtatttaatttggactgtgcagttatcgttgagggaactcacagacagggattaaagtgccgacgacttatcagaacgtcttctgatttctatatttggcgggtcgtgcaggtatcgaacctgcctagtcatttctgacacggattaacagtccgccgcttaccctctcagccaacgacccaaatttggttctccgtaagagaattgaactcttctttccgacgtgaaaggccggcgtcctaaccgatagacgaacggagattggtaggacgtgagggagttgaacccatcgacattccgattaaaagtcggatgctctaaccaactgagctaacgtcctgtagatatttataataacaaaaatatctttaagcaaattggtgggaataactggactcgaaccagtgacctgccgcttatcgggcggctgctctaccaactgagctatattccctgaatttggtggggagtgatggagtcgaaccacccgagtcgcaatgacaacagatttacagtctgcaccgctacctctacggaattaactccccgaaatttatttaagaactgttgagttcatcgatttaaccaagaaaacttggtgtggtgaacgaagtgaaccttcaatagtgcgatgttctggaaaattggttgaagtctgaaaaccagctacacggtaaccttgctcagtccatcctaaaaggataccaaccatacagccagaatattttccgcttttatccaaagctacaatatcaccaggagcaatttcattacccattgaatcaggcttaatccattgtggagtaaccagttctataggtatatttataccgcttgaaaagctgtaatattcgtctgaacgtaagccctgaatgcttttaaagactttatgccaagttttgctgatgctcataatgttctctcgcagtgttttggtgaatcaacgataattcatcgaagattgacttcattgcatttttcacaaaaattttttcagaaggctccatcgacgtattgttgatgattctcgccattcgttctttaagcttctttttccgattccggaccgtctccttggaagcggtcctcatgtgagcaagattagtcatcatgttccgtcgatagattaataatatcaagtaactctttaagcatttaaccgcgtttatacgcgtgatgaatcaaaataccaagtacaccacaagaaactataacgcttttaataacagttaaaacaacgccagtagcaacgccgataagaatccagtcaaacttattcatcggagaatcgacatcataagttttcttaacccatgctttagctttggtgtacagttctttaatttggttcatttgcaattttatccataacgaatgaaatgataccagcaacgagtgtaagtactacgctactgatgagttcagaatttgaaaggaacggccatccgaagattgaagttccaagtgctcccagggttactacagtaaagatgtttccgatgatttcgcaacgtttcatttttaatctccttgtgttgatagggctatagtatcatagccctcaaggaaagtaaacggctaaaactattttattccgcgcgatgcaattgtgttctgtcgtttaacaccagtttgtttaaagtcatgattgtcgatttgatcagtacgagcaacgccaaatgatgatttgatcttagctttagagcctttagttatagaaacaaacatctcagaagagcctttcttaaagtccgaggcggatacttcaacgccgttcttagcaagtgacttcagaattgcctctgcatactcatcatcaagacttgcttgagtattaatgacgaatgtctttggcgcagtagcttcgttgataaattcttgataggttttcatttaaggtcttctgcccaatctagtttaagtggttctttgtattcacggtccagtacaactggtatctgaacttcacccttgaatgataaaggacctacgttataagacaacgtaatgtgaggagtgtagtcaggaaaatcatgcgttgcacctaatgcacgagcataacgatgtcgatgcttaagatattcagaatctagcaccaacacaagtactggtgattctccatggtcccaaacctcaagatgtcctttacgagcgacctcaaagctacccgacgagcatgtataaggtacatttactcttgaatagcaaatcgttgagtgaattttgtgtctaggaactggattaggaaccttcaactctcgctgaaggctctcaatagcatccaatgttaaatcggagaatttagctgcaacgtataatccagaaccgaggtcctggaaattaatcattcaacttcaggttcaacttcatcaagttcaagctgttctggaaccaaagcacgaactgcttcaacaaccgctttgatttctactgaaccattttcatcgccagtaacaccaacgagtttaatgatttcctggaagccagcagacagattctgaataactgcttgagcctgtgaaatttcttcgtttgcgtcaaacagacgagatttcagtgcagttacagtaccttccagtttttggatttgttcgctcatttaattaccttttcaattttagaatagaggtcctctaaagaaccatcgtttgttattacaatatcaccgtctctgattggtaaaccagcttcagtgatgtgagtatcttgtgaactttcactatctggacgaactacatgaattactgtagcacccatcgcccgagcagcatcgagttcatggtcctgacgagtatctggaacaatgtaaaaatccaggtcgtcatggaagctatcgacataatcaatagcgaataacttcaaccaatacatgcggtcaaccatgttgcagaaaatatcagtcccaagggtctgcatgagacgacgtactgtccatggtttggtatttttatttattagggcttcaatcttggtatttccactgaatgaaaaatcaccattgtcatgaatgaagaacccgttttctctttttccagcttttaatttgcggtccaaaagacgataaacacaccgtttcatgtaatcgatgacgtctttattattcagcaacagaatctgttcgcggtcataacctttaccttcaaaatcaaggcggttcaaagatacaccagttttttgggttaaatctggattccagcaatcagctaatgtatctttaattggaccagcaagctggaactttttcgttttgtagttattcgcaagatagtcggcggtggtgtctttacctgaccgtttcttacctatgatgaaaataagtttcatattacctcatagaaggatgcattgcaacagatgaacgagactgagcagcctgttcgatattttgtttacctactatgattttaccatctttttctatttgcaaatacttgaatgggaacatcgcagtgcaaataaccgccgggtcagcatcttcagtatagctgaattctacttcgcctaaatcagaacaccaagctccataataatgaaaactcattacaattttcttcttggagttatcaagcatatgcacagaaacatgaggtggaacgaatccgggtttccatgcttgagagttaaaatctacgtagttgttaatcgaaagcatccattgatacatctgaagccaagagtttaggtcttcatcgactaaaaagcgtatgaccagtgggtcatgctcaaaagttgagcctggcagttgagaacgtgctagaccaccttgtccagatggagtttcagtgatagggatgcgtatacctggtatattagctgattgtacgttaagcgtaaaagctttggtcaatccggcgtcaggaatatctactataaagttagtaatattcgtttggttaaaaagttgattagcgtccaattcgctttccttctaaagtagttataatggttttgagttcttccggagcaatcaatatcaatcaatccggaagaagatggattaagatttccaaacagcagtagcagaataacgcttgccttttgacataaactgctgaagaggaagtaggacaacgttagcccagtctgctggcttaatttctactaaacttcctttgatatgaccaggaagataagctttaatcatcttatccgcgccagcgaaacccttaacttgactccaattaatcttcaacttagttttgttagtaatagtcggagtgttagcatattgctttagcaactcttcgagaaactgttgtcgtgcttttggtggaatatagtgcaagttcaagccatacatcaacgtagttgagccttgtttacccaatcccaaataaataatcaatggaaatctgtcccagaatggaagtgtgtctttatgtttagcatcatacatataagcataaagttttcctggagtaggttttgatacctgatgaccacgaatatttttcttcattgtctcgctgaaccagcgagctgacttattgttaacagctgctccttcattagcaatcttttgacgaatgctctgacggaagctgttaatcatcacaagttgtctttcttgacgagtaagtttctttggattctttccttcgagtttagcaacttgaacagctgtcttaattctcgaagaatatctgctcatagcttttgtgaatgtagcatattttatgcctttttcttcggcaaaagatttggcggtggcacctttctttttagcttcagcatattctacacctatctctacccatcttctttcgtctttagggactgttcgagctatcggttgagcaccttcattaagcaattcaaatatagccattagcctttccaccctaatctcttcagaccatcttctgtaagcaatctgaatttgatgttattcttttcagcaaccttttgagcagctgtccatttatcctgattcacgctccacgtgtatatctcatcgatatatcttttctttgctgctgttgtaagtttagcaggctttggaggcggttgagtctctttctttggtttaacttcaacaaagaattcttggccatttacatctctgaaccaaaaatccataaagtatctacgttttttaccatccgcattacagaaataaggaataacaacttcttcactattccatttaactatttctggatttgcatcgagccatttcatgaaccacgactcccaggatgagcgatatgtaatttttcttatatcacccctgtacttttcatggttcttaggcatgaatttgccggagtacgccatttcattttcctctaataaataatattactatttataaagtggaggctttatgttattcagcttttttgaccctattacatacaccgctaaaacggttgatgaaaacgctaagcctatttccatgacagacattttcagaaactataaagcatacttcaaaagagttgctgctaactatcgtctgcgcacatattatatccaaggttctccacgacctgaagagttgtctaacatcatttatggaaaccctcaattgtattgggtacttctgatgtgtaatgataactatgacccttactacggttggattacaagccaagaagcggcttatagagcttctgaacagagatatgaaaatgctggtggaaatcaggtgttgtaccatgttgatgctaaaggagaaagatactataacttagtagaatctgaaactaatccaggcacatggtatgacaaaggagatactcttcaagaacatcctcaatatcaaggtgctttagcagctgtagatgtttatgaagcagctattcttgaaaatgaaaagaaacgtcaaatcaaaattatttctcctgctgatattgacacttttattgcagacttaatccgtgagatggagattgcataatggaaatgattagtaactctcttcaatggttcacaggggttgttgaagatagaatggacccgcttaagcgtggtcgcgtacgcgtaagagtgcatgggcttcatccattccagaagactcaaggcccagtaatgggtgttccaactgaagaccttccatggatgagtccaatatttccagtgacatctgcagctatttctggcgttggcggttcagttactggccctgttgaaggaactcacgtgtatggtcattttttagacaaatacagacaaaacggaattattcttggaacgtatgcagcaaacgcaactgctcgtccaaatagaactgaaggattctctgacccgactggacagtatcctcgatatcttggtaatgacactaacgcattgaaccaaggcggaaccgaaggcgacgattatacagcaaacatagttcaagataacaatcttgacaccggtattaatccagatgataccgaccttgctaatatcccagaagataataatcctaactatacgattgaagacatgattcgccgtgatgaaggtcttcgtttgaaagtttaccgtgatttaagcggtcgcgggtggacagtagggttcggtcactatattagtgataacccaaatttaactaacgaccaaataaattccgaattatctaaacaggttgggagagaagtaactggaaatccaggctctatttcaatggatgaagcttcaaaattgtttaaagaagatttagaaaaagttcaaagagacatgagaaataatgcagctgtttctccagtctatatgaaagtgaacagatctcgtcaaatggctcttgaaaatatgagtttccagatgggcataggcggattagccaaattcacaaaaatgctagacgccatgttaataggcgattggaaaactgcctacaatgaagcaagaaattctcgttggttccaacagaccaaaggacgagcatctcgtgtttcaatgattatattgaccggtaacttggagtcatatggtattccagtatctcctccaagcccaaaaagtttatcagcggctgctgtagctatggcaactgggtcatctgacccgtggggaccaccagttcctcaaaccggaagaatactttttaaagaaccgccatcgtcatataacggtcaatatccatatgtccatacaatggaaactgagtctggacatattcaagaatttgatgataccccaggatatgaacgttatcgtattgttcatccaaccgggacgtatgaagaagttgctcctgacggacgaagaacaagaaaaactgtcagcgacctttatgatatgaccggtggtgacggaaatattttaatttcaggcgataagaaagtcaacgtcggtggtgatgaaacttattacaatatggctaataagattaatcaaatcgatggaaacaatactctctttattcgtggtgatgaaactaaaactattgaaggcgacggaaccctttatgtgaagggtaatatcaaaattgttgttgatggaaatgctgatattcttgtgaaaggcgatgcaaaaacacaagttgaaggcaaccacgactacactgtcaatggtaatgtcacttggtctgttaaaggtaacgtgtcaatgaatgtcaccggaaactgggctgaaactatgcagacaatgagttctaaagcatctggtcagtacactgtcgacggttcacgtatcgatattggttgaggtaataatgattgacatacttccagtaaacactgaactgcctgatattcaagaaggcggttcagttaatcaaacattcacagctcaattagaagcaacagacacattagagtctataaatataattgattttcaacctactcctgggattatggtctcaggagccaattacaaaggcgtatatgaaagtgtcttttcctttggaggagatgctcttaaatatcgagaaggtgatgaatttaaagtagcacaatcgtgggaatctttaccaccttctggtacagccgatttatacctctggaaagccccctctaaacttgagaggacatttacgtacacagttaaggttatatattggagacaaggcgaagacactacaggaccatctggtgaacctgtcacacctcctccagttaaaatggaaatgaccaaaacctattctcagttggtgtatggtaattggagcaaatggagccagaaattaagagagtatgtttatgcaagaacatagaatctattatctctactgtattgaaaataaagtgaattctaagatttatgtaggagttcactccactgaaaattttgatgacggttacatggggtctggagtggctttgagaaaagctataaacaaatatggaattgaaaattttgaaaagagcatcataaaattctttggttcttcagacgaaatgtatttagctgaatctgaaatagttgacgcccaatttgttaattctccactaacttacaatatgaagattggaggattcggaggttggaatcctagaaccaaaaagcatacagctgaaactatagctaaaatgcggatatctggttcaggagaaaataatgggttttatggaaaaactcatacatctgaaagcaaagcaaaaataatttcatatttaaaaacccgagaaattaaagactcacaccgaaaaactatgagtgaaaaacattcaggagaaaataatccaatgttcggaattactcctcataatgccaaagctgtagtttataatggtgttgagtataaaagtatcgcagctgctgctcgggctgccggaattaattactccacgtttaaacggaagtacatataatggccggattaagttatgacaaagctttaactgcaggccactctgcttatcctccaacgcaagtaaatgcgactcaaggaaaagtatttgttggtggaattgcagttctagtagatggagaccaaataactcctcatactaaaacagttaaaccctacgacactcacgggggttctgttcaacctcgtacaagtaaagtgttcgttacaggaaagaaagccgttcaaatggctgaccctatttcttgcggtgacactgtagccgaatcgagtaacaaagtattcattcacggataaaacaatggcaactactgaaccctttaactatcaattaaaaagaaccgcgaatgcgattcctgaagttttcatcggcggcacgttccaagaaattaaaaagaacttcgttgactggctgcgtggccaaaatgagtttttagattatgatttcgaaggttcacgcatgaacgtactgctggacctcttagcatacaacactctttacattcagcaattcggtaatagtgcagtatatgaatcattcatgcgtactgccaacctcagaagctcagttgttcaagcagctcaagataatggatatcttccatcttctcgttcggcagctaaaacacaaatcatgctggaatgtactcatgcattgaatgaaaacagtttaagaattcctcgcggaacaagattccttgcatacgctcgagacacaagcgctgacccgtatccattcgtaactactgaagacgtaattgcgttaaaagaccaaaacaacttatatttccctcgtgttaaattagcacaaggccgtattgttcgcactgaattaaaatacaataagttgaaaccaattatcatcagggacgaaaatatcgaccgttcagaggttcgtttgttcgttgacggtgcagaatggactaactggacttacaagtcaatggtgcacgctggttctacatcaacaatttattacatgcgcgaaactgtagatggtcacactgaattcttctttggagaaggtgagcaatctgtttccgtcgctggcgcagctttagaagctaactacatcggcgggttaaaacctattcaagaccaaactatcgttattgaatatattcgtactgatggtgaacgagcaaacggtgctactgaattttcttatgctgatacactcccgtatataagtgtacagaaaatctacgaaaacccagatgattctccagattacgttggtgctgatggtggtggtgaccctgaagatattgaacgtattcgcgaactcggaactattaaaagagaagctcaagctcgttgcgtaaccgcaactgactatgatactttcgtttcagagcgtttcggttcaatagttcaagctgtacagacatttactgaccaatataagcctggctatgcatttatcgcaattaaaccaaaatctggactgtacttaacttctgttcaaagagaagacattcagaactatctgaagccatttaacttggctacgattactccatctgttatttctccgaactatttgttcttgaagcataaaattaaagttacttatgctttaaacaaacttcaagaatcagagcagtggttacatggacaaatcatcgataaaattgatgagtattacaccaatgaagttgaaattttcaatgctcaatttgctaagtcaagaatgttgacttatgttgacagagcagaccattcaattatcggttcatctgccgaaattgaaatgattcgtgaagttcaaaacttctttgaaactccatcttcaggtattaaatactataaccagattactccacgcagtttaaaatcaagcgaattcaaattcattaaaggctcttcatcttacatggtacgtttagctggtactgtcggtgatggcaaaaaaggtaaaattgttcttgggccatttaaagccggggatttagcagctactccagccgctccaatttataccggtagtgattttgaaaagcttccagtaactgatggaagaaatacatatttcgttgttggtgaagtagattatccatctgattatatctattggaatatcgcagctcttaatattaactcaagtttatttgacgttcaatcaattgagctttattcttcaccaaaagaaaacaacattttcactaaagatggttcattgattgtatttgagaatgatcttcgtcctcaatacacgaccatcacattggagcctattgcacaatgactgtaaaagcaccttctgttacaagtctcagaataacaaaactatctgcaaaccaagttcaaattaagtgggatgacgttggtgctaacttcttctattttgttgaacttgcagagactcgtaaccaaaacggggagattatactccccgaaaattatcaatggagaaatttaggctatactgctgaaaatgaatttttcgaagacaactacattcgcccattgagttattatgttatgcgagtggctgtggccgctgaaggattcgagcaatcaaattggaaaatgactgaagaatttcagtcattcgaaacgaacgtctatacgtttgaaatgatgcgtcagatgactttatctaagaagttcattgaagaaaaattcactaaagataacgaagattttgtgaattttaaccgtgatactatcatggcatctttgatggatgaaacattccaattttctcctgaatatcgcacggcttcttctgttaacaattttattcttaaagaagatgaataccatgaaattcaaggcgacatagctaaaatctgtaaagataaagagcgtgtaatgcttatggaatctgaaggggttctttatctctttgaaagattccagaatatcgttaaagtatcaaacgataaaggacagacttggaaggccgtacgattactcaatgatcgcgtagggaacccagtatcaaaaaatgtatattaccaaacgcggaacactacgtatctcctgggatacgacagggtcttctacggacgtaagagtaatgacattcgttggtcggcagatgacgtaaaattcagttctcaggacgttacgtttgctaaaattggtgaccaacttaaactcggatttgatgtagaaatttttggtacttatgctcggcttccattagcagttcagaaatatgctgaagctatcacagcaacagatagtatgatttatgttgctggtcgtgatgttgtttacagagctaagactagaaatgctcctatcgaccaagacccattatcacctacgtttggtgaaaaactgttcgataattggacttcaagaatcactggtaattcaaaagcagtttgtcataacttagtttctgtagatggtgtaactttagcattaatcactggtgaagttagaaacgaattagacgatcgtactattccagataatgttatcgattcagaatctaaaggtgtttatcttttagaaggggataactgggtaagagtctttggaaacactgcagaagaacgtagacgtatagaacatggttatacttcaatgtctactaatggaactgatattttcttcagttcaagtaactttaagtttctggactctaatgtggtaccagacccagaaacaactgcaaaatatggtcttttaggcgctgttaagtatgagttcacaagagaatggttgtctgacaaacattatcatatgatgagtttcagaaccaattctaagagcggatttaaaacttttgttccaggcgcgatgaattactacgctgaaccattctttaactggtctcgtaaatcaaaaactcgttgctggattgacacatcatacagaattgtggttgtttattctgatatcactcactctaaagtcattgatattaatggctcgggttctcctgaccgagtgttgcatgaatactgggataaaggcacttgtacagtaacaagtcctaacattcagtttgacaatttcacaaaatatgcttctggtattttattccacaaaatgtcaggtgaaatcatttcatacttcgaatttgattatcgagttcgtgatgaagtgtctatcatatggaaaccatctgaaattttcttaaaagcatatcttcagaaccaagaaagagttgttccttggactccagacaatcgtgacggacttaaagaccctgatttgcgtccattactgaatacaatgatgccagatagctatttgttagaagaaagcaactttgaggctttctgcgaagcttatattcagtacctgtcagatgggtatggaactcagtacaacaatttgctgaatttaattcgtaacaaatatcctcgtgaaaaagacgcttgggaatatttgtggtctgaagtttataagcgcaatatctatttgaatccagataaacgagatgctgtctcaagattctttgaagctcgtaagtctgatttttattcaactaaaggtattgaagcttcttatcaattcttgttcaaattgttatacaatgaaaacgttgaaattgaaattgaatcaaatcctggaacagaatacgatattatcattgaatctgattcagtgaacgacgatttagttggtcatacaatttatacagcgaccgggcgtacaaacgttacttatgttgaacgccactataatgaaggtcgtttgcaatggcgaattacaattcacaaccttttaggtcgtttaattgtaggacaagagcttaaagcagaacgtatgcctggatttagtggtactattgttcagggtgtacgtggtaaagagttagttgaaaataccatagagtatatcaaccgtaaccgttcttactatgtgatgaaaattaaatcaaatcttcctacgtcaagatacagaaatgatgttttaagatttgttcatccagtcggttttggatttattggtatcacgttactgactatgttcattaacgttggtttgacccttaaacacgttcaaactataatcaataaatacaaaaactacaaatgggatgcaggacttccacttatttggcctgaccgagtagctcaattagattcaaatggaaatatcgagcataacgatgttactggagaggctctttatttacctcatccaagagcaaacgaagactttgatattcctgacgactatgatgctgaaaacaataactcagtaatagctggtcagcttccatcggaaagacgaaaaccaatgagtcctacattcgaccaaagtgcagtaacattctccaattggagagatttggttaattcaagacttattgataaagttaatatccctcgtgacccggctaatccaacacaggttaagattaatgaatgattcaagcgtaatctatcgttccatagtgacttcaaaattccgtactgaaaagatgctgaatttttatgagtcaattggtgatggcgataatcaaaacacaatttacatcacattcggacgaagtgaaccttggtcagataacgaatcggaggtggggttcgccccaccatatccagtagataatacacaaggtgttgaagatatgtggactcatatgatgggttcagtaaaagtaatgccttctatgctggacgcaattattccccgtaaagattggggagatattcgttatccgaacccaagaaacttttcaattggtgaaattgttgttgtaaacagtgctccatataacgccacagaagtaggtagtggctggttggtatatcgttgtattgatattcctgatgcaggcacatgctcaattaatactatcaaaaataaagaagagtgtattaagctcggtggtaaatggacttcttctgttcaatcagcatttcctccaagaggacgtggcgatgcaataaacgataataagattgatatgaaagacggatatctttgggaatatctttatgagattccacctgatgtttctatcaaccgttgcacaaacgaatatattgtcgttccttggcctgatgaagttaaagaagacccagaacgttggggttacaacaataacttggaatgggaacacgacgcgtatggaattatctatcgcgtaaaagcatatactattcgatttaaagcatatttcgattcagtatatttcccagaagcagctttacctggtaacaaaggcttccgtcaaatttcagttattactaatccattagaagctaaaaagataccttctgagccaaataaaaaggctaagaatttatggtacaaccctattgatttaagccgtcattccggtgaaatgatttacatggaaaacaggcctcctatcattatggctatggaccaaaccgaagaaattaacatcatcttcgaattctaatgcgggagcctgagggctcccatttttgtataaatagcatatatcaatagaggacttattatgttcgaacaagaagcaaagcaactaattgacgtcggtgaaattggtaacgcatcgactggtgatattttgttcgatggcggtaacaaaattaataacaacttcaatggcatttataatgcatttggtgaccaaagaaaaatggccttagacaatggccaaggttctggagttggacaagtaattcatgctaccggctattggcagaaatcaaatgacccactggaatttactactccagtaccaaacggctcgcaatatgacattgacacttcaggaggagctgtacaagttactttaagtaaaggcgttcgcggagaagcagtatttttctgcaacagcaatggctcattctctccaactaacccattaactattgatgcaaacgacacatttgcaactgtaaaaggttcattaagaattacgtctccttacgtatttgtaaaatgctggtgtatttctgacgaaggcggtcgttccgtttgggattattcagtagaaagtatgtttggtgaaaaacatattccaactgatggcacttggcaattaggagccgttggtacttcagtagatattccattatttcataatactgaatttactgtagcgaagtatcttattactgccgaaaccagtaatggttcaaaagccaaaagttgcgaaataaatattcacatagacagaattaagaaagaagttaatagtgtagaatatgcggtaattcgaattggagcagttgacactccagctacttctactacacctgaagtgattgataaaattttcgttccttcatttgctattaaccctagcacaggatatgtagtcctgacattaacgccaggagtcgctggtttgagagcggcagttaaagctatcgctacacagaaaattgggaatccaagatgaagcaagatattaaaattggtcaagctgttgacgacggctccggcgactacctgcgtaagggtggtcaaaaaattaatgataactttgatgagttgtattacgagcttggcgatggagatgttccatttgctgctggtgcatggaaaaaccacaagacctctacagcagctacattaaacgctgaatggggtaaagcttatgtgcttgatacttcaaccggccgtttaaatgtgcgtcttcctaaaggtactgcgaatgattataataaagtcattcgtttacgagacgtttatgcaacttggcaagttaaccctataactattattcccggttcaggagatactttaaagggtgattctcgtccaagagaaattcgcactcaattcgctgacttggaaatggtatactgccctccgggtcgttgggaatatgttgaaaataagcaaatcaacagaatttcaaatagcgaattgagtacagtagttcgtaaagagtttttagttaaaactaacggacaaactgatttccctgatgtattcagtggaacagaatacaacattggaaatacccaagtattccatcgtggtaacattctgtattacggtgagaaattcagtgcaactgattctgattttggctcaattggaccaaatggaacaagagttgcgcttgatggcaaaagcattaagttgaaaaacccggctaatgcgggtgatactgtaattgtagtatcttacttagacggtatttctcagttccgtagttcttacaatagacgatcagttactctgagagattcatctaaaactaaccagacatctattgaaggttcattattagttgacgatttaaaaactctcagatattttccattgagtgcatttggtattgatagtttttctcctgtaaaccatcaatccatggaagttcgttttaacggaatacttcagaatgaagctggtactgcaggtcttccattagctcgttgtattgatgctattgcagacgacgcatttacatgtcaggcacttggtggaacttggcaaaacagtaaacttgactatgttcttgatatcgatgacaataataaattgattggtatcgaaacagaccgtgaaatggaagatggcgacattattactttaacttggtacaacaaccaaattggtacagtaatggagcttgaagacattcttaatgaaactgacgcaaaatatgtatctaaaggcgaagttctcaatctcactggtcaagtacgtattactaaccaaaacaaaccaggttggcctaatgttgctcctgagccttctactgcatttgaagtaaataatgttcaaaacttatttgatttggtttatccgattggaacaatttacgaaaacgcagtaaaccctaataacccagcaacatatatgggatttggtacttgggttctttggggacaaggtaaagttgttgctggctggaataacgatacaaccgaccctaatttcgcaatgaacaataacgatttggatgtaaatggtaatccaagtcatactgctggtggaactggtggtgtaattagcaatgaattagaaaatgctcaaattcctgcttctcaaacaaccgaaaaagttttagtagttgaccctaatggacctattgtcgtcggcggatgtcaatttgacccgaatgaacaagggccggcttatactaaatatcgtgaatcggttgctaacatcaacccgactcacacacctccaaaatcagtaactaatattcagccatatgttaccgcatatcgttggttaagggtttcttaatgattagtgtatcttcttcaaaggcgggacttaagtcccgcaatgcagatttcttgcaatatgaaatcgccccaggcagtattgatgttatgaatactcagccaattgggtcaaatacgatttcacaaaaatataaaggtgttgattttccaaatgttcaatcagcgatagaagatgttcgtggattcgctattcttccaattggaacaattgtaattaacgatactggcgtttctcctgaaggtattcaacaaattgatgattggactttcactggaacagtagcagttgatggaaaatctgaaggtgaatcagttttagttgatgtgtacggatttatggttccagctttaattggtgataccgacactgaatttgctgcgaaagttaaattagttcttgaagacgctattaccgctggtgacgtaatttcttcagttgaagtatctacatctgccggtaatattttaaacgttaaatatatcgataaccaagaacatattcttccctcatattcttcatgtggagtttccatctctgcttcaatccagtctccttctaaggttggttatgggtcatgggatttaatcggtcgtcaatcattaactttcgatggagctacttcaccgacagttttacaatactttaagagaatgggttaatggctactaatactctaaaccacataagtgacgaatcaaaatataaaacatttaacccggctggaactagttttccagccaacataacaaacgttcaatcagcattagccgcattaaagccaatagcagttaacggcgttcctgacgcaactgaaactgttaaaggaataattcgtattgctacacagcaagaagttgatgatggtgattcagctaatactgtagttactccaaaaactttaaaagaacgtcttggtaatccgcaagcttctactacagtaattggtttaactcgatatgctactacagctgaagccactgcggggtctattggcaatgctgctgttgttccgactggattaaaagcttcaattgacaatgcgtttgctactcgtatttctaaagagtcagttttaggtgtaattaaaattgctacagttgcaatggctgaagccggtactgatgatacctcggcaatgactccattgaaaacccaaagagcaattgcaaaagcaacagcagttcttccagtttatggaccagcgacagaatcagtaagtggtactgtgcgtattgctactaacgggcaagttgctcaaggaactctaagagacgggtatgccgtatctccaagtggattagcctctttaacagctacatcttctcgcagaggtttagctcgttccgctactatcgcagaagttaacgcaaataccgccggagatatttttgttactccaaatggattgaaccaaagagttggtactacttcaacaaaaggtcttgttaaattaactactactgtaggctcaggtgacgcaaatactgcactagcatataacgctgacgttgttcatactcgcggcggacaaacaattaatggaaccacaacgtttggtgctgcgcgagtaaatggtcgtcttgatgttggttctggttttattaacaaccagcaaattgctacagtaaacatgttagttgattccgttccaattggaacaattatcatgtggccaggaaataaccctccaagctcagattggatgcattgtaacggagcattattgaataaaggggattctcaatattctactttatacagcattattggcactatatatggtggagacgctactcggttcgctcttcctgatatgcgcggtatgttccctcgtggtgttggtaagtcaaacatcatgaaccagtattcaggaaacgactcaaaaggtaaacctggtcttggtgctgggtgtggtaacgcttcattaggccaatcaatgccgcaatccgttcgtaaacataaacacgagtcgggttggggagagcatcacaaacgcaatgaagctcgtaatggctgtactgtaagaaatggttatgtagggtctaataaaactgactacgataactataagtggtttactaacgacggtagtgaagtagaagctgctaatattcgtgatggatttggcacaatgaatacagaaggtctaatgggcgatgaaaaccgtccttggtcaattgctctaaactttgtaataaaagtaagataaggaaaaatatgtcaactattgatttaactccccttccttacgtcaacggccttccggatgaaggccaatctcgtgtgaactggattaaaaatggcgaggaattaacaggagcatccaccaagaatggtgtagacggtaatttgaaccgtggaccggtacaggtccaacaaaacgtggaagtgctcgacgggaatatcgtagttgtccgtgattctcttgagcaatcaaatgtaagaattaagaatgtcgaggatgccctaggagtcattggggatgtcgatgttgtcaaacaaataggtattaacacatctgcaattaaagttctccagagtgacacagagggacttaaaaccacatcagatgaccatggtctgcgtataactcacatcgaagaagatgtaggtgaatatgacccgtcacgtgattctgtttatcgtccagttcgtgaagacttgctttggattaaaactgagttaggcgcttatccaggccaagacatcaacggtatgtctattcctatggctccggcgttaggtttgaagaagcgtgttattgacactgctaaagttgtaaatgataactcaattcgtatcgctaatattgaaaaacaattcaatgactcagatgttggttcattaacgattgaagtccaaaaccttcgaaatgaaatgggttcaagagcatctgctggtattgatagtgtttacgttcgtttgaacaaaatgaatggaactattagtactttagcaatggacatggaaaatgttttagattcgattgggtataacaatggagttatcgatttacacaacttggttgtaataaaccgcgatgcaatcaccgaggttaatcgtaaattaagtgaccctacaataggattaattcctcgtgtagatttaattgaatcagctatcggaaaagattctcagccgtcaagcatcaacggaagaattaaaattaaccgtgatgaaattacagctcttaaatctattgttggtgcagatacttcgtctggtttacgtggacaagttgcatggattaaccaagtagttggtattaatgaaagcggaactcctgcgccgtctaattctttaattggacaaattaatactttgactaccatgcaaaaccaaatggctaataccattcaggatatccaggtagatattggtaacaataacgaaggtttaaaaggccaagtaattcgtttaaatagtcttgtaatgggtacaaaccctaacggtgctactgttgaagaaagaggacttttaaacgtagcaaaaactcaagacactgatatttcaaatattaaaaccgaacttcaaaacttaattccagaagctcctcgtgatggaaaagcttatgttcgtaaagacggtgcttgggtcgacttagacactattcttaatcctactccataataaagggccttcgggcccttagaggtttatatggccgcaaataccgcacgaaatccaaaagaacttaaagacgttattctgcgtcgccttggtgcaccaatcattaacgtcgaattaaccgaggatatgatttatgattgtatccaacgagctttagagctattcggtgaatatcattatgacggcttaaacaaaggctatcaagtaattcatattggcgatgacgaaattggtcgtggtcaattcaaaaatggtgtgtttgatttttcagatcgcaacattttcgcagtcacacaaattgttcgtactaacgttggttcattaacgagtatggacggcaatgctacttatccatggttcactgatttcctattaggaatggctggaattaatggtggcatgggtagctcttgtaataaagcttatgggccaaatgcctttggagctgaccttggttattttactcagctcacaacttattggtcaatgatgcaagacatgctcgctccattaccagacttttggttcaacgatgctaccggccagcttaaaattatgggcaacttccagttaggcgatgtaattgtagttgaatgctggactaaatcttatattgacgtggacaaaatgattggaaataaagctggatatggaacagcaggcccagaaacatcttggactcttcctgacgtatatgataatccagataagcgtttgactggttacagagctggtgaagaactttcaattgttcaaggctcttataacaatcgttgggtaaaagattatgctcatattctggcaaaagaattacttggtcaagtattagctcgtcaccaaggcatgcagcttccaggtggtgtcacattaaatggtgaacgcttaattgaagaagctcgattagaaaaagaatatgctttagaacagctttacttacttgaccctccaacaggagtacttgtaggatgatgaataaaaatttgttcgcgaagctcgagaacaaatcaggttattcacgcactaatgaagaggaagttctcaatccatatgtgaacttccataatcattttaacacccaagctctgtttgatactcttgtggctgaaagtattcaaatgcgtggggttaaatgctactacgttccgcgtgaatatgtaaaacctgactacgtctttggtgaagaccttcagtccaagttcactaaagcttggcaatttgcagcttacattaactcatttgagggttatgaaggagcaaatacattttatagcaagttcggaatgcaggttaatgatgaagttactttgtcaattaacccaggtctctttaagcatcaagtaaatgggcaagaacctaaggaaggagacttaatttactttccgatggacaacagcttgtttgaaatttcttgggtagagccgtatgacccattctatcaagccggacgaaatgctattcgtaagattacagcagaaaaattcatttactctggcgagcagcttaaacctgagcttcagcgtaatgatggaattaacattcctgaatttagcgagcttgatttagaccctattcatgaattagacggtctttctgatatcaatgaagttccgtatcaagaagtagaccaaatgaatgatgaagctgataaagatgttaagcaatacgaagtcgttaatggtaccggttcacctaaggtagaaccaccaagaaacagaccacctgctaatcatgtagcatctccatttgatgatggttttatgctataaatagttaaaagcatatacggctcttcggagccgttaggagaaacaatgttcggatatttttataactcgtctttgcgcagatacatcctaatgctgggtgacttgttctccaatattcaagttcagagagtgcgcgaagacataggcaagacatatatcagagttccaattacttacgcttctaaagaacattttatgatgaagctgaataaatggacttctgttaataacgaagatggtcctgcgaaagtagagacaattcttccacgtatcaaccttcatttagttgatatgatgtacaacccaacttataagactggacaacttaatcgttcagcaatgagcaatcctaattcgaagactgggactatttctcaatacaacccaactccgattaaaatgatttttgagcttggaatttttactcgtcaccaggacgatatgtttcaaattgtagagcaaattatgccctacttccaacctcattttaacaccacaatgactgaactattcgaaaacgaaattacatttgaaagagatataagaataactttccaatctatttcaattgacgaacaaatcgatggagacaaacaatctagaagaagattagaatggtccatcatgtttgaagtgaatggttggctttatcctccagctttcgatttaagtggtgaaatccgtacaatttatcttgatttccatgctaacagtcgtgaattggtaaatgaaggtgtatttgaatctgtggattctgaagtagacccgcgcgatgttgaaattgaagattgggacggaaaatctattcagaaatatgacagcgattcaactccaattccaaaagagcctgaaccgcctggaccacgaggtgtataatgagcgaacaattagacattactaaattgctggatattggggatttacctggaattaccggagaagaggttctggcatatgagcctcttcaattaattcctgttgaaagccatccacaaaacagaactcctgacctcgaagatgactacacaatagtccgtagaaatatgcatcaccaatcacaaatgctaatggatgcagctaaaatattccttgaaacagcgaagaactccgattctcctcgccacatggaagtattttctacgttaattggtcagatgacttctactaacaaagaactgttaagacttcataaggaaatgaaagaaatcactaatgagaatactaacaccaaaggtgctggtaatcaagcggtgaacattaataatgctacagtgtttgtaggctctccgtcagatatgatggatgaatatggcgatgcgtatgaagcgcaagaagccagagaagagaaggtaataaatggaacagcctcttaacgtactaaatgattatcacccgctgaatgaaggacagaaaattgtcattcgtccaccggggtctttagagaaaaaggttgaggatgggataacatttttcaaatctcagtgggacgaaaagtggtatcctgaaaagtttgaagattatcttcgcattcatcaaattgtgaagattcgtcttcagggcgaagacccaactaatttcggtacatttaaagacaagaacaataaacgctccagatatatggggcttccgaaccttaaaagagcaaatataaaaaccaactggaccagagaaatggttcaggaatggaagaaatgtcgtgatgacatagtctattttgctgagaaatattgtgccattacccacattgactatggtacaatcaaggttcaattacgtgattatcagcgagatatgctgagaatcatgtcttccaagcgtatgacttgttgtaacctgtctcgtcagcttggtaaaaccacagtagtagcaatatttttagcgcacttcgtttgttttaataaagataaggctgttggtattttggctcacaaagggtcgatgtcagcagaagtattagaccgtacgaagcaggctattgaattacttccagacttcttacaacctggtattgttgaatggaacaaaggctcaattgagcttgataatggctcttcaattggagcatatgcatcatctcctgacgccgttcgtggtaactccttcgcgatgatttacattgacgaatgtgcgtttattccaaactttatcgatgcatggttagcaatccagccagtaatttcttctggtcgtcgttcaaaaattattatcacaacgacaccaaatggattaaaccacttctacgatatttgggatgctgcattatctggtaagtctggttttgagccgtacaccgcaatttggaactcggttaaagaacgtctttataacgaccaagatatgtttgatgacggttggcaatggtcgtctcagactatttcagcttcttcattagaacaatttaagcaagaacactgcgcagaattccatggtacttcaggtactctgatttctggtatgaaacttgctaatatggattggactgaagtaactccggacaatcacgggttctataaatttaaagaagctcagcctgaaagaaaatatatcgctgcactggactgttcagaaggtcgtggacaggactatcatgcattgcatataattgacatcactgaacctcaatgggaacaggttggtgttcttcattctaatagcatatcgcatcttatccttccagatatcgtgcataaatatctaatggagtacaacgaagctccagtttatattgaattgaatagtaccggcgtttcagttgctaaatctctttacatggatttggaatatgaaaacgtaatttgtgattcaatggttgaccttgggatgaaacagactaagcgtactaaagcagttggttgttctacgcttaaagaccttattgaaaaagataagcttatcatccatcacaaagctactgttcaagaattcaggacattctctgaaaaaggagtatcctgggcggctgaagaaggttatcatgacgacttaatcatgggtctcgtaatcttcgcatggcttacaacgcaaactaagtttgcagattatgctgacaaagacgaccttcgactcgcttcggaagtattccggaacgaattagaagatatgaatgacgattacgctccagtggttttagtagacgacggacgtgacgttacagattacacgccaactcacggtgtgtcgtttatataaatatactaaagcacacatgtagaggaattcttaatggctttattatctccgggcgttgagctcaaagaaactagtgtacaaagcactattgttaataatgctactgggcgtgcggccctggctggtaaattccagtggggtccggttggtcaagttgttcaagtgactaacgaagtcgaattagtcgatattttcggcactccagatagcgaaactgctgattactttatgtcagcaatgaacttcctgcaatatggcaatgatcttcgtatttctcgtgcagtaaatcgcgaagtagctaaaaactcatctccaattgctgggaacgttgaaattaccatttctgctgcgggttcaaactatgctgtaggcgataccgttcgagttaaatacaacgtaaacgttattgaatcagctggtaaagttactgcggttgatggtaacggtggtattgtttcagtttcagtaccaagcgcaaaaattattgcatacgcaaaatcaattaatcaataccctggccttggagcaaactggactgctgaagttacttctgcatcttctggcgtagctgcaactctggctgttggaaaaattgtaactgattctggtgttcttttaactgagccagaaactgctactgagcaaatgacttcggtcgaattccaagctgctttgaaaacttatggcatgccaggtatcgctgctctttatccaggtgaacttggttctcaattagaaattgaaattgtttctaaagctggatttgaacaaggtgcaagcgctcaattacaaatttatcctgctggcggaactcgtgtttctactgctcgtgcagtatttggatacggtcctcagtcagatgaccaatattgcattatcgttcgtcgtgacggagcaattgtagaaagctttgttctttcaactaaacgcggttctaaggacgtttacggaaataacatcttcattgatgatttcttctctaagggttcaagcaattatatcttcgctactgctgaaggctggccaactggattctctggtattgttcagctgtcaggaggcgtatctgcaaacgaatcagttacagctggtgatgtaatgcaggcatgggatttatttgctgaccgtgaagctctgcatgtcaatctcttgattgcaggtgcatgtgctggtgaagatgacgaatttgcatctactgttcaaaaacatgtagtatcaattgctgatgaacgccaagactgtctggctcttatttctcctccacgtagtgtgttggtaaatattcctctgactcgtgcaattgataacttagtcgattggcgtacaggtactggaacttatgcagatgcaaatatgaacatcagttctacttacgcatctatcgacggtaactacaaatatcagtatgacaaatacaatgatgttaaccgttgggttccgttagctgctgatatggctggtctgtgtgctcgtactgataatgtcagtcaaccttggatgtctccagctggttataaccgtggacagattctgaacgtcattaaattggcaatcgaacctcgtcagagccaacgtgaccgtctgtatcaggaagcaattaaccctgttactggcaccggtggtgacggattcgttctgttcggcgataagactgcaaccaaagttcctactccgtttgaccgcatcaacgtacgtcgtctgttcaacatgctgaaaacgaatattggaaacgcttctaaatatcgtctgttcgagatgaacgacaacttcactcgttcaagcttccgtatggaaacttctcagtacctgtctggaattaaatctctgggtggtgtatatgaattccgtgtggtgtgtgatactacgaacaacacgcctgctgtaatcgaccgcaatgaatttgttgcgtcgttctacatcaagcctgcgagatcgataaattatatcgttcttaatttcgttgcaacagctactggtgctgatttcgatgaactgattggaccacaagctcaataattctaagacacttagggaccttcgagaggaggtccataaatacaatcatcttaggaaaactaattcatctcggccgctctggtgaatcagagcggtataaatattcgtatgataaagaataactttcatctcgtaaaagtttcaaaccgcaatttagctaaattaaaatctcttggatattccgctaaaagcggagaatacgttcaagtaaaaactgaacatgctcctggaaaacttaaaataacttgcgtttgtgataaatgcggaattgaatattctgtaacaaacgaaaaattaaatgatatagcatctagttattgcaaaatccatcgatgggaaaaatatggagaaattcgtaaagatttctattctacccctcaaggtaaagcggtagccaaaaatagaggtgctgctatatccaagaatcgtgttggtaaagggttaaaacctgaatcacattggattgacaaaaagaaatatcatcaatactgtatgagtgttaaaagacaccaatataaattcaataagttaattcaaaaacttccaggattttcttctattggattaaatggtattgaaggtgctacacaaattgaccatatcgtctcaaaaagatttggttacgataattcagtgcctcctgaaattataggtcatatttgcaatttacagataattccttggaagaaaaatttggaaaaatctgatactaacggtatgacgttagaaaatcttttaacactaattgataaatatgaaggaaaatctcatggagttaacagacctcacgagagcatttgaatccggtgatttcgcgcgtcctaacctgtttgaagtagaaattccttatctcggtaagaacttcagcttcaaatgtaaagcagctccactgcctgctggtatcgttgaaaaaattccggtcggttatatgaaccgtaaacttaacgttgccggtgaccgtacattcgacgattggaccgtgactatctataacgatgatgctcataatactcgtcaagctattgttgaatggcagggtatcgcagcaggtcagggtaatgaaattactggtggctcacctgcagagtataagaaaaaagcaattgtccgtcaattcgcacgtgatagtaaaacaatcactcgtgaaattgaaattacgggcgtttggccaactaacgttggtgaagtccagcttgactgggattcaaacaacgaagttgagacctttgaagtaacattctgtctcgactggtggttgtaaaatgtgggccttcgggcccatataaatattagtatgctttaacccttattggagactctaatgaaatttgacgtcttaagtttgttcgcgccgtgggccaaagtcgacgaacaggaatacgaccagcagctaaataataatttagagtctatcacggcccctaaatttgatgacggcgcgacagagattgaatcggaacgtggagacattgcaggcgctggattattccagagaatgtacggtcaaaatgaaccgggaatgaaaaacaccagggagcttatcgatacttaccgtcagttaatgaataactacgaagtagataatgctgtccaagaaatcgtcttagacgcaatcgtatatgaagacgaacatccagtagttgcactggatttagataaaacaaattttagcccagcgattaaagaccgactgcaagaagaattcaatgaagttcttaattgtctgaatttcgaaagaaaaggtctcgaccatttccgtcgctggtacgtcgattctcgtatcttcttccataaaattattaaccctaaaaaaccgaaagaaggtattcaagagcttcgtcgtttagaccctcgcaatattcagttcgttcgtgaagttatcactgacactgaagcgggtgtgaaaattgttaaaggctacaaagaatatttcgtttataacaccggtcacgagtcttatcaatgtgacggtcgaatttacgacgctggaacgaaaattaaaattccaaaggctgcagttgtttatgcacactctggattagttgattgttcaggaagaaacatcatcggttatttgcaccgagctgttaaacctgctaaccagcttaaactgcttgaagacgcaatggtgatttatcgtattacacgtgcgccagaccgtcgagtattttacattgacacagggaacatgccttcccgtaaagctgctgctcatatgcaacacatcatgaacaccatgaaaaaccgtgtggtatacgatgcatctactggtaaaattaaaaaccagcagcacaatatgtcaatgacagaagattattggttacagcgccgcgatggtaaagctgttactgaaattgataatatgcctggtgcttcaggcatgaacgaaatggacgatgtccgttggttcaagaacaacctttaccaagcattacgtgttccactgtctcgtatcccgaatgaccaacaaagtggagttcagtttgatgctggaactggaattacacgtgacgagttacaatttgctaaattcattcgtgaactgcagcataagtttgaagaaattttcctcgaccctcttaaaacaaaccttattttgaaaggcgtaatgagcgaagatgattggaaagatgaaataaataacattaagatagtatttcatcgtgacagttacttcactgaacttaaagatgctgaagtcactgaacgcagattcaatatgcttcaaatggccgaaccgtttatcggtaagtatatttctcatcagactgcaatgaagactattcttcaaatgactgatgaacaaattgaccaagaggctaagcaaattgagctagagtctaaagaggctcgtttccaagacccagaccaagaacaagaggatttctaatggaagatttcatctccgcactcaaatccaacgacctcgttaaagctaagaaagcctttggtgctattatgcttgaacagaccgctgatttgattagccaacgtcgtgttgagattgcccaatctattatgattgaaggtgaagaaaaagaagacgacgaagacgagaatgatgattctgaagatgaaggtaaagaaaaacctgaatctaaagatgaaaaagattctgaagacgaagaataaggagtcgcaatgctgattgttcctgatgagtacgaagtcgtacttgaaaacatcgaagcagctattcctgaagccgaatctcgttttaagcagttgtcagaagctctcgataaagcagacataaatacaattgtagaaaacatgttgccaattgaacctgaagtagcaattgctatgggttcactgaatgaagaaatgcagctcaatgaatttatcgttaagcatgtttcttctcgtggagaaattacgcgtactaaagaccgtaaaacccgcgagcgccaagcattccaaacaactggtttatctaaagctaaacgtcgcgctatcgctcgaaaagtcgttaagtccaaacgcgctaatccgtctggtactgtacgaggcaaccgcaaacgtaagaaagctatgaaacgtcgtcaggcgttaggattaagctaatgaatgaaccccaattactcattgagcattggggtcaacccggcgaaattttgaatggcgtaccgatgcttgagtcatacgatggctcagatgcagggctaaaacctggattatacatcgaaggcgtgttcatgcaagccgaagtagttaaccgaaataagcgtctttatccaaagagagtattggaaaaagccgtagctaattatattaaagagcaggtttctactaaacaagcacttggagaattaaatcacccaccacgtgctaacgttgacccgatgcaagccgcaatcatcatcgaagatatgtggtggaaaggaaacgatgtttatggacgagctcgtattattgaaggtgaccatggtcctggagataaactcgctgcaaacattcgtgctggctggattcctggagtatctagtcgtggactaggctcattaacggaaaccaataaaggctaccgtatcgtaaacgaaggatttaaactcaccgttggcgttgatgctgtgtggggaccttctgcaccagatgcttgggtaactccgaagcagatttcggaatccgctgaggcgcaagtcgccaaaaagaatgacgatgagtcatttaaagctctcgtagagagtctcgaaaaagcattataaataataatgtaacttaacaacaggactaacaaaatgctgaaagacatcctgctccaggaagctcagaatattgaagctaccgtagctgtggacagtattttcgaatcggtcgagctttctccggaagtaaaagcgaagttcgaaactgtattcgaagcaactgtaaagaaacatgccgttgaattggctgaatcccacattaccaaaattgctgaaatggctgacgaaaagctgaaagacgctaaagaagaagccgaagaaaaagctgaaaagaaactgaccgaacatgcttcgcgtttcttcaatcacatcgctcaagaatggatgaacgaaaacaaactggctgttgataaaggcatcaaagctgaactgtttgaatccatgttcgctggtatgaaagaactgttcgttgaacacaacgtggttctgccagaagaatcagttgatgtagttgctgaaatggaagaagaactggctgaagctcgtgaagaaatcagcaatctgttcgaaggtatttctgctcgcgacgaaaaaattaataccatgctgcgtgaaagcgctgtaatggaatcaactaaagacttgaccgacgttcagaaagagaaagtagcttctctgaccgaaggtatggaatattccgacgaattctcaagtaagctgtctgccatcgtcgaaatggttaaaggctccgtcgagaaagaggtagtaaatgaaagcataaatactaccgacaatgatgctgacggtctcaacttcattactgaagaacacattgagccagaagaaaaagtatcaaaacagccatcgatgatggacgcatacgtagcctctgcggcacgtctttcttaatttttaaaaggttataaaacacatgaaaaagattaatccgttagtagaaaaatggactccgctgcttgagaacgaagcactgcctgaaatcgttggtgctggtaaaaaagctctgattgcaaaaatcatggaaaaccaggaatcagctattaaaactgaacctgcattccgtgatgaaaaaatcgctgaagcatttggttcgttcctgactgaagcagaaattggtggtgaccacggttatgatgctcaaaacatcgctgctggccagacatcaggcgcagtaactcagattggaccagctgttatgggcatggtacgtcgtgcaattcctaacctgattgctttcgacatctgcggtgttcagccaatgagttctccaaccggacaggtattcgctctgcgtgctgtttacggtaaagaccctctggccgctggtgctaaagaagcattccacccaatgtacgctccagatgcaatgttctctggtcagggtgctgctcagaaattcgcagctgttaaagcttccgatgttctgactgttggtgctatcgtagttcacgatttcgctgatgttggtcgcgcttacttccaggttgctgaaggtttcaccgtagacgctggtgctaccgatgctgaaaaactggataaagcagttaaagctgctgaagaagctggtcagctggtagaaatcgctgaaggtatggctacctctgttgcggaactgcaggagaacttcaacggttctactgacaacccatggaatgaaatgggcttccgtatcgataagcaagttatcgaagctaaatcccgtcagctgaaagctcagtactctattgaactggctcaagacttacgtgctgttcacggtatggatgcagatgctgaactgtctggtattctggctaccgaaatcatgctggaaatcaaccgtgaagttgtagactggattaactactctgcgcaactgggtaaaaccggtatgactcagaccgttggttctaaagctggtgtatttgacttccaggacccagtagatattcgtggcgctcgttgggcaggtgaaagcttcaaagctcttctgttccaaatcgataaagaagctgctgaaatcgcacgtcagactggtcgtggtgctggtaacttcatcatcgcttctcgtaacgtagttaacgctctggcagctgttgacactggcgttactcctgctgctcagggtctgggtcaaggcttcaacgctgataccactaagactgtgttcgcaggtatcctgggcggtcgttataaagtatacatcgaccagtacgctcgtcaggactacttcaccattggttacaaaggtgctaacgagatggatgctggtatctactacgctccatacgttgctctgactccactgcgtggttccgacccgaaaaacttccagccggtcatggggttcaaaacccgttacggtattggtatcaacccgtttgctgatagtgcatcacagcagccgaatgctcgcattcagtctggtatgccttctatcgtcaactccgttggtaagaacgcgtacttccgtcgcatctgggttaaaggtctgtaatccaattaaatgggagccgcaaggctcccattgttgtttctacggatgataaataaaagtataatccactagaggaaaagcgacgatggctaacatccatgaccttctgcgcgaatcaactacaacgacgagttcaatttctgcccgtcctagcctcgttgcattgactcgcgctactactaaattaatttactctgatattgtagctactcagcgtactactcaacctactgctgctttctatggtatcaaatatttgaaccctaacaaagaattaacgttccttactggtgctacctacgcaggtcaaactggtactgaggaccgtaagtctattgaaacattaactgcttcaaataaagattcatttggcaagggcgatttattcaaatacaatgacattgtttacaaagtacttgtagataatccatttgaccagattactgaaactgatttagaagttgtaattcagatttctctggttaaactcactactcgtttaatgtctgatgctgctatcacttccaagtttgaaactgctggagctgatatcgctgaagctaaattccaaattgataaatggcagactcaagttaaatctcgtaaacttaaaacgagcttgactgttgaattggcccaggaccttgaagctaatggctttgatgcttccaattttatcgatgatttactggctactgaaatggccgatgaaattaacaaagacattttacaaagtcttgtgacagtttcaaaacgatataaagttgaaggtatcacagatactggattcatcgatttatcttatgcatctgcaccagaagctggtcgttctctgtatcgcatggtatgcgaaatggtttctcatattcagcgctcgacatcctttacagcaacattcgctgtagcatctactcgtgctgctgctgttcttgctgcatcaggttggttgaaacataaacctgaagatgatgattatctgtcacagaacgcttatggtttcctagcaaacggtttgcctctgtattgcgatactaacactccactcgattatgtaatcgtcggtgtagtagaagatattggtgataaagaagttgtatcgagtattttctatgctccatacactgaaggtatcgaccttgatgacccggaacacgttggtgcatttaaagtaattgttgacccagaaagcttacagccttctgtagctttactcgttcgttatgcactgtctgctaacccgtatactgtagctaaagatgaaaaggaagctcgaatcattgatggcggggatatggataagatggcaggacgttctgatttatcagttcttcttggtgttaagttaccaaaaatcatcattgaagactaaaagaaagggaacctcacggttcccttttgtagttataaagcaaatatatcgaatgttggcgcgtacttgtctttgaatctctgatagatttccttttcatacagattgtagcaaggtatcccatgacgcttagctatatcaacggccactcgtgtccctccagtaacgctagagagttttattggagcatagaatagtaccatatctacgggtgactggcagtcctctccgagcacctggagtgcattgcgggcaaataaagtcttcactatatcccggcactcatcccagtaacttgtcacttctcttgctttaattacactcctgattctcacttcatttggaaaatctttccacacctttactccaactccggttttaagaccattgaagccttcgtatggtatgatacgtaatgaacgttcacggtcgtatctactgagccatgattcatctgcaccaggagcacctcccgaatacgaaaaatggcccgactccgaaagagcctgaccagttaatgacatgacatctaaaacacgacgtggcgtctctcgagaaccgattaacgccaaacgcattagttacttaccagttcaatccaaaccggacgaattacgccttgcacgtaattgacaagctctttcttgactacatcaggattatcagcgtcagtaatgaagatttcttcacgaccagcttcttccagaatatcctggacagtaagacccataactttgccaaagtcttttggaccaacttgaccaatcttactgataacgttattgactcggttcagagtagcataagctgccagggtggagaaagctaccttatcagcatcagtcagttcaaccttagctttaataggcttatcggatttagctttctcagagaacttggagttcttgcatttgatagctacacgagaaccattagggaagaatttagggtagcatggtttcagaacgtagccttcagcgatgttgctttctgaaacaaccgcctggaatggcatagtattagcttcttcaagaccgtgagcttcaatagcttgattatagcgattaactacaacatccagcatattaggaatttgaatcaagtcatcgaatttaccacgacccagcagtggagccattttaaacccaaagacattacacatgcgttccatcataaaatcatcaacataagacgattcaccggattcggtagtcactttaatatcaaagacatagaagtctttttcaccgtaatcaacacctttctgaattccgccgacagcaaattcaccaaagatttgataagctacagtagcaccagtcagtgcagcttgaacagctttaaatgactcgttatagcgacccataataaccatataaccaaagaagtcttccgctggcagaataggaccagtacgcttagcaggctgaatgctatctttagttacgataacagagaagttagtgccgtgaattttctcacgtgctacccaagtttcagagacatcaaaaccagcattacgaatacgctcaatgaatttaccgttgtagtggttctcgagcgttgaatatttctcaaacatatttcaccttagaatttaattttgaaagactgaccttgatagtcagcattgaactcatatgagaagccatttttagaaaagaatactttcatagcttctacattattgctccatttttctggaacaatataaaacgtttcaaacttaccacgttgtgctgcggaacgcaggttatctttaatatgagctttaatatcttctggtagttcatcacgcacaccctgcgccaatgctctgtattcttgagctagactcattataatcaccgtataaatatcaataattagggagggttctatccttctatggtcaagcgtatgtactagaaagaatccgtgaaaccattataccacgcggattctttaagcatattatagagggattaccttatacttcttattgccacgagcatcacgcttacaaactaatctgcacttcatgccgcttgcgattgtgtaatcttcatcaaccttcatccgcatccagtctaatatcattccaaatgggttcaaagatttttcaacttcaaccataatcttcgttccagatttatagaacttcgattcttgttgtacatggtcagccaatgctcgagaaaatgcagacggactcaggaatttgttataaccatgagctgcagctacaaatgtgttatctaatgcatgctgaatgtttttgataactaccttagaatatccaaggtgtttttcaggatactgattcattaaatcccctcatatgttttacgagttgttgatgacgagattctacatcagtattagataagcgtttacgatagacgatgatttctcttcgtttaactcgtgaccgagcggcttcaacatttgcgtaatgcagtgcagcttcttctggcttaatgccagcttctcgagcgatttcaataaagctcatgccgttttcatgcttaaaatgaatctcaatcggtgtcattactttatcctacagtgaaagttgttggtataataccattctctagaaaaagcaaaaggagcccgaaggctccttttaatagatgataccagcatcaagtgctgttctgtggacgattcgtccatttcgtgattcttgcacatcaacttcaggatagtctgctatcattttagctaatgtagctaagtggcagtaatatggagtatctgatgcagttgctgtcttccagtctttaccttcttgagtcagcttctgaatagcatccattacccaccaacccgcccagatataagcagatgaacgccatggaagtggatggacataaagaatagggcattcagctggaatttctggttcagccgcattaacagtcaaattggtagtagcagtttgaacatcatctggttgagcatcaactttagtcgtagacgtaactttaacaactttagttcctgctgtagctgctgtgtaatctaaagtgtttgtaactgaagattgaactacatcatcaatcatccattcgtaagttacagttgaaccttcaggtgctcccgtcaaagtagcagtgaactgctgggaatctccaatcttgatagtgggatttagtggcgctaaagtaattgaggtagccatatattttccaaagttaaagagggactagccctcttatgaaagtgtagcaaatgaggagtttcgagtttctcttacttgaactgaaccattacgtttgatgtaataaatcaagctcaaaagagtttgatgagcagtaggatgctcaaatgacagtggtcgagatttccaatctggattttcaagaatccactgataaatccaccaaggaagagtagcatagcctggattacgcccaattaaatgcagagatggactgaaatcagtcggaagctcgaatgtgtcagtttcaataactttgacaactttatccatagcttcattaaattcatcttgggccatattccttactggaattttatgaacttcaccgtcatctgaaactataatcacagaatcgccgattggggcttcaagaataacgcctttagcagggtccattggcttaccaaaatgagggtcgatatcagttactttcacttgtggcgtatctgccgatacagaatcaatcaacagacgagcttcttctttagcttcatctttaaaaatagcagtgcctttggcctcgtcgtcagcttgaataaggtcatagattgaaagaccgtcattctgctctggcatgggttcattagcaagtttagccaattcgacttcaaggtcagcgaccatattgtcaaaggctttagttttcttcagcttgatgccgaaggtttcagcgtactcggcaagcttttctttggcttcttttttctcaagtgcaccgatttcagcaatataatctttatctaacatagtagcctcgttgtgtataaatataaatgtatttataactaaggaatcggcaatgcacgatatcaatgtaaaatttcatgattttagtcatgtgtttattgagtgtgatgaatccacattccatgaactaagagactattttagttttgaagctgatggctacaaattcaatccaaagtatcgttatggacattgggatggacgtattcgccttctgaactatgaccgtctgttaccgttcggcctcgtcggacaaatccgtaaattcgcaaacaacatgggttattcagtttacttcgaaccgaagatttttgagactgaagaaattactcgtaaagattttgatgactggcttggtaatctcaacatttactctgggagtaaaaagattgagcctcactggtatcagaaagatgctgtatttgaagggttagtgaatcgtcgtcgaattctaaacctcccaacatctgctggtaaatctttaatccaatgcttgcttgctcgttattatgttgagaactatgaaggcaaaattttaatcatcgttccaacaacagcattggttgaccagatgattaatgacttctgtgattatcgtctgtttggcaaacaacattgtcttggtattcggtcaggtacaaagcgcgattcagatgcgatgatttatgttgctacctggcagacagccgttaaacaaccaaaagaatggtttcaccaattcggcatgatgatgaatgacgaatgtcatctggctactggcaaatctatttcaactatcgttgctggtttaaataattgcatgtttaagtttggcttgtctggttcattaaaagacggcaaagctaacgtgatgcagtatgttggaatgttcggtgaaattttccgtccagtttcaacatctcagcttatggaagatggtcaagtaactgacttaaaaattaactcaatcttccttcgttatccggacgaattcaccactaagatgaaaggtaaaacttaccaagaagaaatcaaggtaattaccagtgcaaaacgtcgtaacaaatgggtagctaatttagctgttaaactggccaaaagaaatgaaaacgcgttcttgatgttcaaacatgttgctcatggtaaagagctgtttgaaatgattaaagaacttggtcatgagaaggtgtattacgtttcaggcgaagtatcaaccgaagttcgtaacgcattgaaagcgatggctgaaagtggtacggggattattgtagttgcatcttacggtgtattctccactggtatttccgttaagaatcttcaccatgttattttagctcatccagttaagtctaaaattatcgttctgcagactatcggtcgtgtacttcgtaagcatgattctaaatcaattgctacagtatgggatatcatcgatgatatgggtgttaaaccaaaatcagcaaatgctaagaagaaatacgttcatttgaactatgctttaaagcacgcgctggagcgcattcagagatatgcagacgaaaaattcaattacgtaatgaaacaaatcgatatttgaggaagctatgagcaatcttaaaacttttgaacaaatcatttacgaggcatcgattgataacttcatgagcaaaattaattcttgtcagactttagatggtttgaaagagcttgagaagtattatgagaagcgctcaaaagaagctgagctggctgattctgatgacatcagtgtaagggatgctttggcggggcgtcgagctgaactcgaagctgcagatgattctgagtcggaagaagacttctaataaaaaggcccctcgaaagaggggcaaaccacaagtggcataaaacactaggctacattaaaagttgcgtttcgtttaattgctcttctgcgctttcgcttaccggcaattcaatcgcataattataacaagcacctggatgaacagggcctttatctgtttcaacaaccaacgccgaatcaatcggttgcttacagacagcacaaatcttttcagacatgattgtctcctcagttattaacaattctatttattagtcacctgcttcaaacctacgcatatcaataatatgcttgattgagaatccacgagatttgatagcatccatcgcatcacgacagaactccaacaaaatcccccaatattgcaaacttgtatcaatacgaagaacttctttatcagcagacagaacagtcttcatttcggacttttcataacggtccatgctgaactcgtcaccatcgcctctgcctgtgtaataatccaacttctgctttaacgcggacttcttcgaagcctcgatgcgaagcatttctttacgaatagcagacaattttgtcaaccatttaccataaagaactggattattagctgcttcatactgcaatttagttgaatcaataatcaaatcttgtttcaactcttcctgtaaatcttcaagcttcataatcacctttctttgttcaatttgttactctagcaaggaactcaaaaccattataaccatcttgaaatgaaagcgattagttacggcttgagcttgccaactgaagcttaatctgctcaaggtcgtccgggttgtcaactacagagaaccgaacttcaacgataagcgtatggtcatcgtaaaccggagtaacattcacttgtagacgacggactcgcggttcatagtttcttatagcagatatgatatttcgttctactgtatcagctgtcagaggagtcatgttctcgaaaagctggtcttgtaaatcacacccaaagttagggtcgaatggacggcttccctttcttgttgttataatacctaaaagagagtttttaattgctcgtaacccacgagcacgtgcaacgtctttggaccaatccattttaagttcagggtccaaatccgaataaaggtcatttatatttgccattacagatacctgaagaattctttaaggcctttaatcacttcaacgtgagttgctccgcatttctggcatttcacaggaactgctagataaacggtaggctttaaaagcatatttttgatgcggataatatcctcttcagtgatagctgagtaaaggtcatcgatttctttgtcattcaaatcttcgattgaaatggtttcaccattcacatagatgtactctatacatgtagcaatcatctgtgcgatgttcttatcatcgaataattttggataacgaagcttaagtttaaaattcgctagaggataccagagttcctctggttcatcgatttgtgcagatgtaaagttaatcggtgttaatgtttcgtgaccttctggacatatccagatgttctcatgattaacctcacctaatgagtgagaccataactgaatcagcagaagttctgattcttgcttgttaaggtttttcgctgatgtacaattattaatcagccgttttactacttcatcaatgtttccattgattttgccatcgatgagctctttgtattcttctaacgtaaaagctctgcattgaatatcagagccattaatctggacttcaaatttgtaatcgtagttcatattagctccttacggactatttataaatatttcaataaaggagacctctatggccaatataattcgttgtgtactaccggacggggtccatcgttttaaacccttcacggtagctgattacagagatttccttctggttcgtaacgatatgcaacataaaacttacgaagaacagaaggtgattataaaagaacttttagctgattactttggtgaataccctgagactttacgtccatacatgttcatgaaagtattcactggctcaatcggtaaaacaaaaattccagtagctttcacttgtccgacttgcgaaaaacaaaagcaagttctgtttgatatcagtcaagaggatttggttgaacctactattgaagtggctggaatcacaatagctttcaaattccctgagaaggaatacgaagataaagctgcaatgatttatgattgcattaaagcaattaaatacaacaatcaatggtatccttggaaagagatgtcggaagacaaccaaatccaagtaatagaagcaattgacttcacaacgtttgaaaagatttacactcaattaactccgatgagatttgaacttaagatgaaatgttgcgagttgagaacaaacgtgtatgaagacattttatcagtctttaagcttctgataaacccggatgaaatttttagcttctaccaaatcaatcacactcttgttaaaagttcatacgatttgaatagtataatgggtatgattccaatcgagcgaagcatcgccctttcgctagtagagaaggacaataagaaatgacagtactacaacgtccaggttttcctaacttaagcataaagctctatgaaaactacgatgcttggttagataaccgtttccttgaattagcagcaactgtaacgacgcttactatgcgtgatggtctttatggaagaaatgaaggaatgctgcaattctatgataacaaaaatatgcataccagaatgaatggtgaccaaatcattcaaatttctgtggccaatgcaaacagtaaaagaacattgaaccgcatttacggttgtaagcatttttcagtttcagttgactctaaaggcgataacatcatcgcaattcaacttggattggtgcacgagattatcaacctcaagtttagtcgttgtttcttcaacgatgctggagagtcaattaaagagatgattggtgtaatttaccaagacactcctcatattgctccagctataaactcgattaacacctacgttccacgagttccatggacgagtacattaaaagactatttagcttgggttagagaaatatctctggctgtcgaaagtgaccaattcgtatttgtatgggaagacatctatggcattaacatgatggattatgcattcatgattgcccaggagcctattccggttgttgttggtgaacctcgccaaattggtcaaatggttaatgaattgaacaccgaccttgcttataatttcgagtggctcactaaagctaaccaatttactcgtaatccaatggctaatgctacattttatgctcacagcttcttggataaccaattccctcgaattgttacgggtgatggttataactcggtgttggtatctcgttcaggctcatattctgaaatgacttatcgtaatgcatatgaagaagctttacgtttaggaacaatggcacaatatgatggttatgctaagtgcactatggttggtaattttgaatatactccaggtcaaaagataaacttctttgaccctaaaaaccaattccgcacaaacttttacgtagatgaagttattcatgaagtttctaataacgaatcaataactacattgtatatgtttactaacggacagaacttaagtccagtagaaccaattaaggtgaaaaatgaatttaaacctaatacttccaatgaaaacaatccaagttaatcagaaggaaataaaaattcctaagcttggattgaagcatcacaacatgctgaaagaagttaaatctccagaagagaatttatcactgctgattaattcaattcatccgggtttaacaccagctgaaatcgattacgtttcaattcatttacttgagttcaacggtaagattaaaagtaaggtagtcaaagacgattttgaatatgacctttcaactttaagaattgttcaacgattagaatttcaattcgctggtcatactttcaaattcagagctcctgagcagtttgaaggatttggcggtgttgataagatgctttcaaaatgccttgaaacggtagacggtaaaaaagaagatgtcgacttcatgaagatgccagcatttgtgaccaaatgggcagatgacatttcaagtaccgtagcagtaagcggccctaatggcgacatcagaggagttgccaaaatcataggaatttttgaatgaaaaccgaaaacatgaagactatgcgtcggaaggttattgaagagggtcgtagtgaaagagatgcagcgaaagctgcatcaactcaatccgaatctttatcagttctttcttcgcagcttgatgatttacaaactcaagctgagcttacgtctgaagtaattgaggataaaggtaatcaagttattgatgccttgaatcgagttgaccaaagcataattgatactacagccggggctgaattaactgccgaagcgtctgaaagaaccactgaagctgttaagcagcagactgaagtatcaaacaagatttcagataagcttagtaagctgacagaacttttaaatgaacgtctttcagctattactccaaatcttccacagatatctgttccagatacgtcactgtctgtagttgaagatgcagtacctgttgatatagtgacaccagggttaccagaattacttcaggagttaattccggacccggtcaataataccaataaccctaatgatgcgttcttccctaccgttccagagaacccagagagtgattctaaaaagggagctgatgaggagcgtaagaagaaagactctgacactctgagcaatctgcttaaagcgacaaaaagcggattcaaagcttcaatgagcattacagacagaatagctggaatgcttttcaagtacactgtaactgctgtgattgaagctgctaaaacagctgcactgctgttctctatcgtgctcggtatagatgttataatgaagcacttcaagtattggtcagataaattcacttcagactttgataagttctctgttgaagctggcgaatggggaagcacattatcatctatatttggaacacttgaaaatattcagaagttctgggaagctggagattggtctggattaactgtggctattgtaaaaggcgtaactgaaatcatttacaacctcggcgaactcatttctttgggaatgtcaaaagtggctgctgctattctttcacttattcctggtttaggagatgctgcattatctgttgaaggagctgcattggaaggtttccaagaaagaacgggtaactctctttctaaagaagaccaagacacattagctaagtatcaatcatctaagattgaaaaaggcgaaaacttcttcgataaagtatctcaaggtaaaacttggattgttaacaaaataactggagatgctaacatttctgattttgttacagatgaagaaagagaatcccagaatgaaaaacttcgtcagatgaaacctgaagaaagggaacaagttctgaagaaagggaatgaagctcgtgctgctattgttagatttgaaaaatacatggaacaaatcaaccctgacgataaacgttcagttgaatcagccgataaagcatatgctaatcttcaaacgcagttaaacgacactgacctgaataattctcctgtaactaaaaaagaattaagtgctcgtatgaatattgttactgctaagtatgataagctcaaaggtaaagaacctcagcctgctccatcgtctcaatctgaggatgttaaaaaagtcgaaagcattgagaagaataaagcggctaaagaggcttcattaggtactagtgctggagctgctgcggctaacttgttcaatacaaataacgtcattaacaacagtagaactataaatactgttagtcctgtaacgagcactaatgctccaggcgtatttggtgcaactggtgttaactaaggaataatcatggctataagagctacagaaattctagataaagatttcggcagtggagaaaagacctctgccggtcaaagttctatttcgtcaactcgaagaagtactatagtagctcaatacccggcacaacgtgctgccggtaacgatgctgcaggagaccttcgtgttcatgacctttataaaaatggattgctttttaccgcatatgatatgagttcaagaacatctccggaccttcgtagtatgcgtcaatcccaattgagtaaatcagcgagttctattcttaatagcctcggaattaaaaataacggccaagttgataaatctccgattgcgaatattttacttccacgttctaaatctgacgttgaatcaacttctcacaagttcaatgacgttggtgaatcattaattactcgtggaaataattcagctaccggagtattgagtaacgttgcatctacagcagtatttggtgcattagattcaatcactcaaggtctgatggccgacaataacgaacaaatctataatactgcgcgaagcatgtatgctggagcagataacagaacaaaagtattcacttgggatttgactcctcgttcagtagctgatttagtttcaattattcagatatacgagtgctttaattatttcagctatggcgaaactggcaattcaagttacgctaaagaattaaaaggccaattggatgagtggtacaaaacaactctgctgtctccattaactccagatggagctgatttgaacaacacgatgtttgaaaatatcacttcattcttaagtaacgttattgttgtaactaacccaacggtatggttcatcagaaactttggtaagacatctaaatttgatggaagaaccgagttgtttggtccatgtcagattcagagtattcgctttgataaaactccgaatggtcaattcaatggtttagcaattgctcctaatatgccaagcacttttactctggaaattactttccgtgaaatcttgacattaagcagggcatcactttatgcagaaggtttctaatgcttaatttagatgaattcaacaaccaagtaatgaacgttgattttcaacgtacaaatatgtttagttgtgtattcgcaacgactccatctgcaaagtctcaattattgttggaccaattcggtggaatgctttataataacttgccagtctcaggagactggcttggattatctcaaggcgaatttacacaaggaattacatcaattatcactgcaggtactcaagaactagttcgtaaatcgggtgtatctaagtaccttatcggtgcaatgacaaaccgtgttgttcaatctttattgggagaatttgaagttggtacttatttacttgacttcttcaatatggctttcccaacatcaggattgatgatttattcagctaaaattcctgataacagactgtcacacgaaacagattggcttcataactctcctaatattcgtatcaccggaagagaattggagccacttacattaagtttccgaatggattctgaagcaagcaactggagagcaatgcaagactgggttaactctgtacaagacccagtcactggattaagagctcttcctgttgacgttgaagccgatattcaagttaacttacatgcacgtaatggattacctcataccgtgtgtatgtttaccgggtgtgttccagtttcatgcggttcacctgaatttacttgggatggtgacaaccaaattgctgtatttgacgttcagtttgcttatcgcgttatgcaggtgggtgctgttggtcgtcaagctgctgctgattgggttgaagataggcttgttcatgctattggaaatatttctgatgacatgggtctggactcatcattgtctagactaagtagattaggaggcgctggcggtggcattactcagatgggtaatgcgatagggcgtaagactggaatgtggaatagtacttccaagatacttggactatagaaaaagggagccgcaaggctccctttgttttatttgcggaacaccacgaaagcattcagaacaacttccgaagattgctcaacgttagttacagtaattttaaacggaacttcaccatcaaacttaccgttcagagtataagcgatatacccttcacatttgtcttctggaattccgaatggtgccagtggaaccatttcaaccattcctttagcaatcttttgaatctcattaaagaccatgttgttgaattcgtcagatactggaactacaccttcaactacagtttcttggccattcatacgtagaatcgatttcatgatgttctcctcagttagtgtaagtctatagtaacacacttccatgtgtgtgtaaacggttaaagaacgaacttctctggagtgtcttcaacatcaatcattgaagctaacagagcaagaatcttgttgttttcagatgtctttgtggatttaacaaatccttcaaaatcaaatggacttgattcaggctgaggttcgtcactgtattctaccacttcaccagtttccatcagaacatcgccgtcataaacaacagcttcgtctaattggtcagcagtcattacttcggcttggataaatttctgattgttgtaaaccatgccatcattataggaagcgtctgtaattttattaatctggagcatagtaccgcgcggaagaataacttccatttcacctgacatattacttaagtcgccaggataaaccacgttaactttctcgccgccagtaatagcccaacctaatgaaatgcgaatacgttcttcaccatattcttgaaccattctaatttcttggtctggaacaatagcagtttcatctgatttatcaactgttaaaacagcacgagtattatcagaagccattgcaactgcttggttacctttccaaccaccaaagataattggagataaagatgttgaaacatagtttctgaaatagaatactctgttcttaaccatagcttcaaaaattggtttacgaactgactgtgaacgccataaggtaagtccttctggaattttgtcaccgcgtttaaatgcatcgtccaaatttttgatagcagtagtaacttctttataagacagcgtatcgtaattgtcagctctataacgtcctaaaagcatattgttgatatctgaataaccagagccaacatactctttaatgccgcgtttttctgcattcgtatattgaagaggtgtacgagtgcgagtgatatcttcaatagtagcagaaacgtttttagcataaccttgaagagctgctttaatcattttggtacgttcaatgttccaaagattgttagccatttgctctttatcttttggctcaaggtattgtggaactttagtcatgatatgttccattgcttcatgtttacgttcttctaaagagtctaaaagagtttgagtatacgcctgcatactctggactgaagttaatggagcgttaccaattcttgattcaagttcttttacaaatctctgttcaaatttttcagattggctcaatttaatcgtggttaacgattttaaatggaaaatagcaccagtagctgctaattgagcagaacgagctttagcagctttagattctaccgcatccttcaattgctgagcttccggaataggatttgccgttgcgggtttactgaattcagcagcagtagcttcgtatttttcaaattcttctgggtcatgaataatgtcagaagttaaagattgacttgctgctacttgacgacgagataccttagcacgagcaataacagattggtcagtacgtttgtcgttctcttgagcgatagtagctgctaaagcttctgatttagaaacttgtttacctgacttattgttgatgtaaacatcgccaacatcagtatcaaccttggtgaactcttctgttgatatctctgggatgccagggacggttgagagatcaacattcttacgatgaataagaacatacacgtacttcttatcgtaatcatagagttctttcaggataacaaaacgaccacccagacgactcattaccaaacggttgataatcatctgcactgctcgagcttgtccacccattttgcttttagcaatacggaacatcactgcatccattttgtatttcttcacagtttgagatactaagtcaaacatggtagaaataacacccaatggattaccaccaagatttttcagcttaaccaaggtacctttttcagatacaccaagcacaatagcatgcatcattttatcgccaggtttaacgttcttgttaacgtcaccaccgccggtgtaagaacacatacgaagagctactgaaccttctggagcagcaattgcaaaaatctgtggaattttagttttcggataaagattagtgaccggaagcatttctgaatccgcgtcaaaaacctcatttaattgaaattcggtcattatgagtcctctattgtttcttatatttatagacaattaaagccccgaagggcttagactgcaataatattcctgaagatttcaacttttccgccaccccgagtagcaatgacctcgtgtttgttgattcctgaaactcgaccatctgtaaatgattctacttcaccttgtgggcggaatggtaattcgaccaagctctgtgttacattagcggctcgtcctgagccttcacctgggtgagcaattgtgataatctctaaatagaatttcatagaccagtaacctcatggaaatcgccccaaatatcagcgaacgtatttgctacatctttatcacgacgcattttaatcgcaataggcaagaacagtttgacataatccgtccgaccttcagcagctaaccagccattacattcggattcaagaataccaccgatgtattcatttttattgagccaaatacgagtacggtctaactcatgccaatctgaaattttgtctttaagacctgaaccagctttaactttaatcagaccacattctgattcaagataaaaaccaccggctttgcctggttgtttactatgctcatagatatcaacgatgcgaaggtcaatcgtaataacttctttgaacttataaaggtttttagaacgggtgttttcccagaaagcaccaatgttcttcaggataataccttcaagaccttcatcaacatatttgcgataaatgaccttggcttcatcaagattatgaacgatgtggttctcaatcagaatcatctgagagtaacctttaaccatcagttctaatgcacggaagcgaacatcatacgcaaatccagattctttaccttcggaataaacaacatccaacggaacgtaatcccatacttggaatttcataccagcagcttctttagctgagatagttcctttcagagatttattggccaacccgtttgacattgtacgggattcttctttgaattccttagctttacttaactcaggtaaatcgccaaagatatcgtccaacggaccagcaggttcaacgatagcatgataaacgagttcaccgtcaatcattacaccgccaggatggcgttcacgagcttctttagtcatttcgatgagctgttgtttcagcaaatctaaaccaagatactcgttaccagcacgagacagaatttttacatcgtctaattcatcaccacggatttcagcaaatgctcgtgcgccatcagccttcagttgcgcaaatgcagggaacttaatgttctttttaatgcctttttcatcataagatgaagcaagcatttgaggttgttcaggaattagatttttccatactttattcgcaatactacgggatgcaccacagcgtaaatcacgaagcagaactttcttaataacttctacatcagcttcatttaagtctgcaatataacttgctaattcagcaatagcagcattcccagtaatttcacgagcagctaatttaaattccaagaaatctaaggcatcatctaacgtcaatagaccaaagctttgagtgcgctctccagcagccggccatttcttgatgtaatactgaagcttaccatcataagtcattctgaatactcgcttcagaagctcattatctttatgacgacggatgatagcttctttttcttttgtggagccaattgaagcaagttcattgataatatctaaaatcatattcacctcgtttattgtcccgagcgggtatgacaattatatcataccctttgtaaagctattgcccgcgatactcacgaatgagttcagccaaagttcggtggtaaattactccaccatttttacgagtaatgtagattgcgccattgaacattgcatcaatcatttcacgttgcttttggttctcaacatgaatgttacgagctttgaagaactcttctttgtttgcgaaactttcaatacgctttgttgtgtcagtttctggaaaccattgaattacattaatcatgctttacctatagttactttagcggtgggttgacgattcagatattcgatacctgtcccaattccaaagtttggacgatacacaggaaaatttcctggatgctcataccatggcttataatcagaagggcccgggtttacccatttctttggaaattctggaaacttatcaaatggccaattcggagtagtcttttcaacctttttgaataagtcactcagcttatcaccaagactttcctggaattcgcgctggttcatcagacgttgaacatgttcccagttatgcaccttttctccgtacttggagaaagtgtctcgctgaccacgaggcatgaacatgcaattgacttcaccgccaaagacttcataagctgaatctacgtgatgaggaaggtcatcaatataagcaacaactcggtcaccgtacttttctttgattttctcgaagagcttggtttttggctcagcgtggtcgcagatgaaagtttcaaggaaagcacctgggaacaaagcgttcaagttgaattgacgattcagtttagcatcaacagaagtaccaagcgcagtaaccgcaacgaagtcatacttatctttcagagcattgacaactttcagagcatcgtcgtatgctgccagatagcgaatgaaatctgagcaattatatttgaccatcagctgttgagcaaattcttcgtctacaccaaacagatcttttggcgcaacgaattggtcatcaataatcatttcaagaatgtggtgaacaggcagattgtacttctgagcgaagtaaggcaagcctgattgccactttactaatacaccgtctacatcagtagagataattggtttatttgacatttttagccttcattttagcaatcatgtaagccgcgatacaagatttacccggcagtgatggttgtccaactccacttaatagagtagttaactctcctactttaataccgccttgatttaagcgttttaaaacatcaagacctttcatatcatatttgacttgcataacattttctcaaaggttgcgatactgttagctgggccacttagagttatctctatgaacccaggctgacttgaaggaccaattctgtatatacatatggctaatgttcttgcgtattccagaaggtccttcgttaaccctcttacattaaactgtttcataaacttcgtcattagcagctttaagaggctcgatttcacattctaaacgaatatcagtattcccgtcaacccattgtacttcataagcaggttgaacaccatattctggaattgattcagcagtatcacagatgactcccggaataccgcctttgcacagttgtacgggttgtaaaatgtggtatttcattctgccaccgcataagctggaatttgatgaaagaaatcagggcattcaagctgatacttgacttctgtatcagagacagttacgcccagcacttcaatcattggattgctcaacatgccgcgttcaaattcaggtgctttattacgaggaatagtgataatcattacagagtctccaatacagttttaactttagcttcagcaacttgtttaacaaccagaacacgaacaccttcaactgcattacgaatttgcttttgagctttttcgttagcttcctcttcagtgtaaggaccaacacagaaaggctgttgatagcgattagttggaatagtcatcatccagaaatcttttgcatcagactctgttggtttaacttcttcaaggtacttgttaacatcagtagccaagaagaagcaccatactatattgaatacaccaacattagcatgatgaagtttaccatcaacatcgattgcaatgatgtttccgtctccgtcgacctttttgaccttgaatgaagtttgtccattgttcagcaatttaagaagttcctcagaataagaacttccacgatttttaaaattagcaacacccaattcagacaacttaaactctttatcaagaatactcataactatttcctcaagtgaggggccgaagcccctatttttagattacgaattcgtttgaaacgatatcccaaattgcttcacgttgttcttcggttgttttctgaccaagaacatgacgcagataaagtttaaccagaattttacgattatcaccattccaagaaggatgagttcctaaatcgcgaatatgaactttatcatgaaaaccaattttaataacagaacctttaagagaaatatctaagcatggtccgttttcaaaagcgaagaagcagtaattatcttcccagtacatatcgatttgagcaaccgtaccgttgatgtgtttccataagcaaatcggagaagaccaagaattttcttttgcatatttacgttcgaagttagtgtagttcattttgttctccgttgtatctgtttgtttattgagtttatatactaacacatacaacggaggatgtaaacggtttagttcacttctgtgaaaattgtttgaggaacgtactcggttttggcagttgcaatcatcttcataatgatagctttaccttcactgtttttacgcaagaacgacttgcatgcatcatgagcttcttcggacgtcataagaatagctatggaacgctcgtcccctacttggtccaaattcaaccaaacgttttctttcttagtctggcctaaagctacatacatcacttcaacgggcttttcttcagcctcaaccaggaaatttttgacttcagttgatgtgaaccaaggacatgaatcaccattcataccatcaatatcagcaccttttgggctaatccaaccttcattttcaaatcggataagaccaacagagccatgagcaatagcttcaccttttgcaatgtaaaaaggtctgtcattgatgtaatcggcaatcaattgatttactcgctgattacaaccttcagcgaactttaaaaagccttctttttctaagcggtacagaacatcacttttcatagtttcctcataaggcccgaaggcctagaacattttacgttcggtccagttatcaagattaactgtaccagttttcttcattttttcaatcaagttatctgcacgagtgcgtccattttcataccacactacatcttcagaataaccatcttcgtcttcataagtttcagaacgaatatgaccatgaatgcttgttttcaaaacgtattcagtgccggtgaaccagttagtcagaacgatgtaccagcagaaatcagtagatggaccttcaggagtcatgcagtgaactacatctccttgccacgaagacagatgccacattggctcttctacttcgattgctttgtatccatcgtggtctttcgttttgatagtagcattcagattaattgtgttcattttgttctccgttaccgtattggtttattgagattctatcataacacaacttttggcagatgtaaacggttagagtttttcgcaactatggtattcagcatctgcccaaatgccgaatgctggcaatgattctagcattgagtttccaacttcaattgggtcttcccatggccaaagtgtagcaatcttttcatagaaaaagactgaatccatatgtgaatattctgcagggtattctgatataactttgaaaataaatttacgtttaaacatatgaacctctggatacaaaaaagggactcctgaaggagtcccgaacttatgctttatgctttcttacgtggattaccaaaagccgtgtcgtgagcaataactttacgagcacgagatgctaacttatctgttagctgattgatacgcttgttcgaaccacgcttgtagccagcgcgtttagaggtaccaacaacttcttttactgcagtttttgctttagcttgtttagccattttttagtcttccatataaggagtaataattgagaggtcttacacctctcgcgtttttagtagttttggttatttaacgactggatgactaccaaccacgtcaacatacactcttatctgttgcacaccgttagctttaagggtccgggtccatttctggggataagatattcaccgatggatgaataggccataggagcactcccgattggccatcgcctcgaggtgtcatgcccttgccgtgtcaagccccatagggtacttatttcagagtcactacgaagtgacgaaccgctttacgagctgctgaacatagaggtttagcaaacttcagctcatctttcagagcaagtgcatcgcggaggtctgcctgaacaggattcagatgtttgaagcctttcagaacttccaatgcttcggcgtaaacgtcgattgatgcaccgtagttttcgtgacctgcgttccaggagttacgctgcagatgcagagcgtgttcaagttgtttgttcattgacattatgtcattcctcaatacgaggttaataaaaggtagacggtaccagaatttaagctgcgcgtctaccaccttgtaatttctccgggtaacttttgtccggcagccaaattacaataatatttatatcacccgtagatacacggaattgatttccaatgacaagtcacaaatttttgtgcaatttcttttggttttttcataccagcagcgacaagcggatgaggtacattacgaatctgaccagttggcagcggcactaacataccgacttcgaaaataccttcaggaacatccgcgccgattgaatagatttcacacatatcagggatttgtccggtttcttgtttgccgataacaataccgccagaagaaacgatttcatcaccttgctgaggaggttcagaaaccaagataacatgttcgccgatagctttaattggtaaatccattgttacaccttgttgtttgagcatgaaataatattatcatgctcatatttaagcaattaacctttaacctgaaccagtttcagcagatgctctactttaacaccatttactgaaacgatagaatctagtttgaatgaacgccatgcgtgtttttcagtgtcccacactggaatagcttcagtagattctttacgagacacctgagagccaacgctttcaaccaagtcgcttggaatgatgtcatggtcacgagtacaacgtagagaacggatagtaccgtctactttctcaaatactacttgagattcgccacgagccagaattggtttcagagtatcacgaatttgtactttttcagcttcagtcagtttagttttcttagtcattttcaacaccacagtagttttcaacattataccaattgagtttattcaagttcgtcttaggaacatgatgaatctcaataccagcatcgcggaggatgttatcccaaccgtcgacatttttatcgtatgtttcacaatatacgagtttcttaattccagattgagcaatagctttggcgcagtctgggcatggtgaaagtgtaacgtacatcgtagcgccttcaattgaagaagcattacgtgctgcgaacagaatagcattcaactcagcatgtatttcgttaattttcgaccattcagaatgttcagctcggaatttagtgtctaatccatattttggaattggaccatcttgacgaagaccagttccgggtttcttaactaaccaccctttatcttcggcatggtcgcaacagttaactccaccagcaggagaaccattatacccggtagaaatgatacgaccatttttctcaataactgcaccgactttccaggagcagcatttagattcttgggaaatcagataagcgatttgtaagacggtgctagctttcattattgaatcaccaaatagtttgaacggtcagttttaatcagtgtaatttcagtatgaagaggaataatctcttgtaccgtactagtgattataaacaccccatctttaaagcgtttctttccgtcgaagaaaacatcaccgtaaaaacgttcacctacgataggagaagtctggtctttagaagtgataaggattccatcatacccgtcgcaagaattcaccagacggtcacacgctaatacagaacgaatgaatccaacaccatcttcagtgaattgagatttatcaccacaagcattgtaatgttcttttcggacaccatcgaagatgtcagttaaattcatcaaattatatcacctaaaacgttagtcattgtaacatgtccataacggtcaagagttaacaaagctgtttggtcctttccattatgagtgattgtaattaaagctccattagaaacgcggtcaggacggagctgaacctcagctcctggtactttatttgctaaagactgcgcgaattctttaagcttttcccgaaattcaattcggctaaaagttttatcagaagtcactgttgtcccagctgtaaattacagagaagaaaatagggtcatctttatcaatgtctaaacggaaatcaaaagtcattgaatagctattgaaagatggcgtaactttaaatttaaggcctttccacagaatttgtaaagcacctacaatatcagcatgaatttgcgcatgagttggtgctgttgctggaacaaacagaaaattatctgcaacctgagctacaacaacttcagctactttacgaaaacttgaaagacctggacgtacttcagtatgaattcccattagtgcaccgtgtgtactttaacgttaacgacaaagtgagtaacaacctcaccaattggaacgaactctacataatactcatctttgtatcgagagttcatatcggtgcgaatttgagcaagcttattgattagctcaggtgtcatattcataccgacaatttcacgaagaagcttgtaagcttcctctttgacctgttcgtgtttattatacatcatttcaccttatgcatttttccattttcttccaagctgccaatctggatgatttagtcttgggtcattagggtctgtagtagacgatttctcaccagttctagagatgagccattttctagacttagctacttcagaatatttctttttggcttcatcagttcgtaatttgccagtgttggctttagagattctatcaccccacactttgacatcagattcactcataaaatcttttacatttttgccaaacattgggttagaagaacctttgaatgatccacctcgttttaatcgagtatctttggattttaaacctaaaccaggcaactttttacctttgttccatggttctgcacctgaatcatatcgggctttttggctttcagatatcttatgagatgtttcttcactagaattattattaagcccgttcttattaatgaaatcccacccaccttctccgcctggctttaaattgtaatttgtatctagttggataaattcttccgtaactaactctctttcaagagaatatgcttcttccttagtatcaaatattgctaaaatatctttaacgaatgaagatttgccatactttgcttctgcattcttaaatgcggtgccagatcctaaataagaatcgttttcttttagtgtcttgtgaacaccaatgtaaattttattattcacaagacacgtagttttataaactgtatacttttccataaatacctctataatatagaggtatttattagtagattgcggcgatttctaactaaaagtctccatgattcacttgccagcattcaacaccaatacgacgccacatttcaactacttgcgctcggtcatcaactgcgagtttaacattgtaatgaggagcaatatcacgccagaagatttcttcttttacgacgtcatctttacgagaatcaccctgttcgcgttgaaaatgttctgtaaatggaatgaacttatctgtgagccatttacgagtcatcattttgtatttgatttcatcgtctttatttcctgattcacgaccagaaacaacgataatagcataaccgtcacgatagtaagaacgagcaagttcaacaaccatcggattgatgacgtcagtatcacatttttctaagtcatatggactgcggtccaccattttggctaatgttccatcaacatcaaaaataattgcttttggttttgaagcatcgggaacataaacattctcgacttccatcaacgtatagaaatgacgcagaacatcaatcgggactgctttatcaccacgatattggttgcgcttaaccagttcagtccaaggaacatggaagtcctggaaagacatttcatacagacctttgaaacgaagttcccatttctcgacggttttagggttcaagttagtgtcgcagacgataacacctttggtgtgttcaaggtcaagcagagacactgcagcagaaatttgagcagctgttactgcacgctctttatgcttagaatatttgtaagcattgcgagcatcaaggccaaacagcttttcacggaaatcatcacgagacagaatgtaccaaccaggatttttagcgacatattcatttgcccaagttgactttccacaacccggcgcaccacgagtcaaaataatctttttcattcaagttcctttacaaaatcattaaggtcagatttagacttattataatcttccagagttttagctaaccattcttctttgcggccatctagtaatgctgaaagatatgaaccttgagcaaatacatgattactaagcaaacttattaatcgatttgacaaagcaattgagttatattctttaattgctttacgtaaattatctccagcttcgtctaaatcacgagctatactttcaagctcttgttctgctttaacagaattgtcatttacacgaagtccataagcatatgcataagatgctttacaatatttttcgagcagaagtttaatgggcattagcaatttcctcgataatgaggtttacacgtacttcagcttcatcatatcgagctttggcttgcattgtttctatcgcaaggtcttcgtaattcaaatagccatcttcaagctgcatacgagtctttgctgaaccataatcaattgcacgagccttaagttcagagatggctccttcgagagccattttagcaaatttgttcatagtccaagagcctcatataaagatttgcgaatttcacgaacgtctttacctgctggtcgcattgcgccttcaatatctgagataaagccattagcgcaattggatttaacttgaccgtaaattgaagcagcttcaataagcttatcaatcaaatcacgtttatagtcttcttccatacgaatgccatgccattcatcgtaatcttctataggagcaaagattttgaaccaagtttcttctgaaatataagtttgttctttaagtttaaagacgtgagatgggatagtttcagttcctggagcaaaaactctaactgaaactactgtcggttttccatcaatgatttcaaaccagggactcacggtagctttacgcattaatggagttttgtgacgggcaccctgcatacacaatttgcgtaactgggtctttttaattgcagataagaatgagccatcttttacaaaataacgcatattattttcctcaaagtttattatcccgatgaggcccgaaggcctcaattaaaatacaactacggctgcaagagctactgtacatacaactgcagcgatgaacagaccaaaacaaaacagctttgcacctaacgtgaatttacgcattttggttcctttaattcggagcgatagtaacatatcataccattagcatctttggtataacgaagaacatcattcaaccaaattctaaactcctgagaatcagaataaggcattcctacaaacggacggccatcaacttcgacgatagtccaatgcccattccaaggtttaatttggtcaggccaagatggatgcactacagttggctggggtaactctggtgtcttctgggaacatccagccaatagtccaattgataatacggcggctactaagagtttcacttggtggcctcctggaactctagagtcaatttgttgaaagactcatttaactgcttttcaaccagcttaggcttagctttgaccacatgctcgcgtttagcatctttagccattttagcatcagacttatcggcctccgctctgttttctttacgtacttcatcgtacgtattcaaatttttgatatctagctgaagcttatcaatagctttgccttgagcttctgctacttcttgaacttcttttagtccaagttttaagttatcgattcgcattgactggaattggataaatccataagctgccagtcctagtgctactacaataacatgtgtgtttgttattttgaacataatttgatgattgcctgtacaatatcatcctgagaaagaccattgataagaatatgatgttcagcaggagagttttgaattttgaagcaggggtccaccatctctgccatttctgaagcggacagacgtggatttgaaacacccagacgatgctttccatagattgggtctacaatgatatagcacttgcaaccatttacgtgaacgtttggttgggaaatgttaatcatcacttctgcaccgtacttggtcagatgattatctaagaagctgcgcatttcttctactgcttcaggcatcttctcagcgcgttcttcatttacgcggttactatattctttacgagccttttgacgcttttggtcgcgagagtaagctacacgtaaatctgtgatgtaacccagaggacgagaatttttgaaaatacgaatcccgtcatgatgagtgccaccgtaaatttctattagttcttcagcagtaattaagttcagcatttcgttttctccatttggttagtgtagagacatagtaacacaaccaaacggagatgtaaacggttagatgtacttagccggagtgaacggcttagagttcttcaagaacgcagcgttcagcttcgtgatgagctggtcgtcatcaaggtctcctgcatacattttcatgatgataccgaaaatctgaggtagacccgctgcggcagtagccgcttgagcatttgctgcataagtcttacgatctttaccacgatgagtagagtagaagtcttggcacagtttaagagctgaacgaagatagtctaagtactgagtttcaaaggcattaatcttatcgatagctactttatcattatcaaacatgccacgaaggtcatcagcagcattgttcacgatgcattcaaacagacgttggttgttgataatagaatcctttgtatgatggagagcacaataccattctgttttcagtttgaaacgaagaccatcttccattacgcaaacataaccttcaatttgttcttcagcacgaatcttggaaacgaaatctccattaggaacttcaaatgcttctaccagatacttacgaagaactggatgcgctaaaaggtcttcgtaatcaatgtactcacctgtgtcattttcacgaacgttcagaagaataagcatcttttcatggtagttcagaacaattcggttttgtggagaacagtattcaaagttagcagtgaaaccatcttttgctaaatcaatcagagcttcagccaaatccagatgatcgatacttgctagcatagcagaagcttcaacagcctgctcagatttgatagaagtcttagacttaaagcgaatacgattttcaccgtccaaataagtagaaaccaaggagccatcttctttggctaacatatacttaatcttagaaaggtccagattcatagtgaatggagtttcattaagattgaagaacttttccattggacgagatgcgatacgcaccggggtatcatctgcatcaagttcaaacataatgccacgacactctaatgcagacggcaggagccagtcagagtaagatgcgtaatggtaagaaaacgtgcgatatttgtaccccattggagatacatcatcacggtagaagaaacgagtttcatcgttacatagagtcatgagctcattgaataattttttcactttttacccttattaaatttacaattatcgtagtgccatctgatcgcagtagctttggaagctattataccacaatgtggacaagccgggtacaatgctttacttttgcccttttgagactcagaacgtttacgcttggtttcttctgattgaatttttccggtcaaagattgtgatatctttttacgagtttcaataccaagaaattttccttcggtatgacttcgtcttccttttaaagcattagacaaattagttctgtgctcatcagtgcgtgttctccctgtaagtgattttgacactgatttagagtggttcattcttgctcgttcataaaactttgaatgaactttaaaagttttatcagcataattgcacatcatccaaagagcaaagagcaaagagcatagtgcattttgctgttgttgtgtatttttgataacaatagatgagctataaaatgctctctggcggttagtaaaaccaaattactatcgtcatcacttcctcccattgatttaggtactacatgatgagattcagtgtagtaattaatttttgttttatcgaggccgcgcaactggcctcttgataccaagctattgtatatatttttatagttcattttttcttatgttgaacattccatggaggattgaacatctttatcagtagtggctcctcaaggtccatcgttgagattgtcatctctccaagttcattgtttatcaggagattaaagcactgtcgagcataaaagctaacagtctttcctgacatcagagcatcataaatcttagctgacttagttgaatccgatgtctggtctttgcgattaatcgctgtcctgtaataatttattctctttctgagattcttggtcttaccgatgtagaccaactcatcatcaactgcaattgcatataccacgttcaacttgtttggaacttggacttggtctatagtgcaatcaggtagcagcttcagttgagtgtattctataaaagaaaactcgttagcaatatctttcataacagaagggcccgaaggccctctccttacaaatactttctgaatttcaacagcacatcagcatcgacatcgttgtcaatctgagctacaaggtaacttgagatttcaacttcttgtggagcagattgtaccgcatctgagtttaagtattcacgaatccatgggattgggtgacgaacaggagcgtcagtaatcgggcatggaagaccacagctacgcatacgtgaaacggtcagatagtcgatgaagtcatgaaggattttcactgaaagaccaggaactccaccatcgcgccacagatgaactgcccattctttttcttggcggttgatttccatgaagatatcaactgcttcctgttcacattcacgagcaatctgaacccattcttcgccatcagtaccaagttgaagctgacgaataatgtactgcgtgcctttcagatgaagctgttcatcgcgtgcaatgaacttcataatcttggagttaccttccatgatttccatgtttttatggaagttgaaagtacaagcgaaagatacatagaaacgaattgcttcaagaccattgatgacatgtagacacagataaagtgctttcattagttcacgcttagcatcaatgacatatccttcatacatttcaatgtcattttgttggcatgaaccaagagattcttcataccgctctttagcgttttcccacagacgagtcttcagaattacatcgtcataataatgaccaattgtctcagctcgtttcatgattgcttcatcaagaacaatctcgtcaaacaccttcgccgggtcattcagcaagttacgcatgatgtgcgtatatgaacgagagtgaatcgtttcagagaaagtccaagtctggttccatgtatcaagtgacggatcagaaattaaagcagaaagaacagccgccggagcgcgaccttgaattgaatccagaagactttgatatttcaggttatcaaggaatacgttttgctggccaactggaagcttttcaaattgagctcggtcagtcatcaggttaacttcttcaggacgccagaagaacgagagttgtttctcaatcagttcttcaaatgtacggtggcgctgaatatcatatcgtgcaataccaagcccacttccaaagaacattggctcggtcatcaaatctacttgttgtgtattaaaaactgtgctcattatttacctcttaggaccatccgtggtccaattataaactgaaagaattaaagcttacatgcagaacaatcttcggcttttggtttctcgatttcaaaatcatcgttaccagaaccatcacgagtgttatgatagtacaatgtcttaccaccaaagtaccagaagtaaagcaagtcgtccatcataacagacattggcactttacctttctcatagttctgagggtcatagtaagtattagctgatgcagattgacatacccacttcaacataatagctacttgagtcagataaggtttgttaccctgcttagcaagtttccatgcataatcatagaggtcagcgttcagttcaacgttcggaactacttggttgaagcttccttctttagactctttgatagagactggacctcgtggcggctcaataccgtttgtgctgttggaaacctgggaggaggactcacatggcatgagtgcggacaatgtactgttacggatgccatattgcttgagttctacacggagtgcttcccagtcacaaacgtaattcggggccgcgagctggtcaattctcttattgtaccagtcgataggtaattcgcctcgagaccaacgagtgtctttataatactcgcaaggtcctttttcttttgcaagtttaattgatgctttgatgagtgcatattgcagcctttcaaacagttcgtgagtcaggtcatttgcatcagcgtatgtagcaaagttatctgctaaccaagcagcgtagttcgttacaccaacacccaatgctcgacgtttaagagctttcaaagcttctttaaccggataaccttgataactcaagaggttgtcgagtgctcggacttggacttctgcgagctcgttaatagtttcttggtcttgccaatcgaagttgccgagcacgaacgcagacaacgtacacagcgcaatttctgcgtcttctgagtagacgtctttagtaggtaacgcaatttctgcgcagaggttcgattgcttaatcgtagccacatcacgaataaaaggaccataattaccaacgttatctacgaagtaagggtaaattcgagcagtgcctgaacgctcagttaagaataactcaatcagttcacgagctttgacacgcttcttacgaacatctggattcttttcaagagcttcatattgctcacggaacgcagcagcatctttgaaatagttctcataaagtcgaccagcatcaatgtctggagagaacagagtgatgtaatcgtctttaatcagacgttcaaacatcaggtcgttgatttgaacaccgtaatccaagtgacgaattcggttttcatctacgcctttgttgttcttgagtacgaggaggttttcaacttccaagtgccagattggatagtacaatgtcgctgcgccaccgcgaactccaccttgggagcaagacttaactgctgtttggatgtgtttccagaaaggaataactccagtatgcttgacttctccgaagccgatttttgaaccttctgcacgaatcatacctgcgttaatgccgataccagcacgtttagagatgtactctacaattgattcagcagatttgttaattgatttcagtgaatcaccagcttcaataacaacgcaagaactgaattgacgagtaggagtacgagcacctgccataataggagtaggcagagaaattttcttagttgacacagcatcgtaaaaacgaatagtgttcactaaacggttttcaccatcatcctgatgcagagtcataccaatgagcatgaatgcaaattgaggagtttcgatgatttgaccagtgctgcggtctttgaccaggtatttttcaatgagttgcatcgtaccagcatacgtcatttcaaaatcacggtcatgaacaattttactttcaagcagagcaatttcttcagcagaccatttggcaagaatttctttgtcgtatttgttgtgattaacaccaaatgaaatctggtcaataaatgaacgaggctcaaactgtccataaacttgcttacgaagattgaacatcgccagattacttgctacatattgataatctggttcttcaattgaaatcattgaagctgcaactttagtagctgcgcgttgaatgtcataagttgtcattccatcttgcagatgtggaacgatagcttgatatagctcatatgggtcaactcgggtgttttcacaaccccattccagaactttgataagtttttctggagtaaattcctgagaggtaccactggacttaattactttcatgcaaatcctctagcgtaaatgtgtctttgaatagtctgtttactatatgagctattatatcaccatggcaagctttaggtttacaagtgcatcctaatctcattccacggagggtctccaagtgctcacgttttatttcaccactcctaatacgcttaatgaagtcctctttaaaggcttcaatggcagcctcccggctgccagcatttttaccaacgtcattaccccacattgtacctcgttggatattaacgtcgaaatcagaatggtatttattaaccactcgacaagctctcatttaacttccacaataaaccatgtatcatgaattaattgattagattcaagtccgaattcttcaaaaccgtgcgctttttcgtatgcatggacaacgttacgaacatagagacgcgctccacgaacttgaataattgaaccgacctttggaatttcagaatcacggatgttataaacttctgcgatagggtcttcttcattattttgaattacaattctaagatgtggcattatgctttactcacaataacaacgcgttcagtagattcaccaacaatttcaatgtgatgagccagaactatatgaaaatagccattaatcataatagaagagtttaatttgaagtcagcatcgcacagttgctcatcagtttgagcataaacgatacttcccaaagcatttgtaaatttagtaatcatacagccatttttcctttgattgttgggtgactttcatagttaactaacttgaagtcttcgataacagcaaatcggtttatccacttaagctgagatgaagtttgccagcgctcaaactcaattggaaaatcaatttcaagctcacagagttcttttggctctcgacgaagaatttcttcgcactgctcaatatgatttgaataaatgtgagtgttgccaccagtaaataccaaatgaccaggttttaagccagtcattttagctacgatatgaatcaaagcagcatatgatgcaatattgaatggtagcattatgttcagctgaggtcgttaatctcagcccggaattatatccagctgcatgtcaccatgcagatcagactatatctccatctcattgagatgtctatcgtttcgagtcacttgaccctactccctcacgggatagtcgttcggcgtttaggtaaaaccaattccatttatcagatttcacacgatatgtaactagtccagaagaaatatcgaaatgtctagctgcgtcagaagcgcattcaaatacaattccatcacatgaaattttcttgatattactgggctttttgcctttcattttatttgacaattcttttctaaattcttcggtgtgttctcttccaaagaaaggattattttcgcctgaacgtttacgacaattagagcatgtttttgaagtatgtggaattcttttcccacataaacagaacttatgtctttctggcttccaattaggattattttcaccagatttgccgtataattcttttcttttttctgaaccaaaagctttcatttttgctttaactgttttactgcgtttagcaagtatttcttcctttttaggattattagtataagtatcaccaaatgaagcatcagcaatattatatccgttttcctttgtattaagcttgttaatccagaaattttcacgttcaataatcaagtctttttcatatggaatttcttccaaaatagaacatttaaaaacattaccgtgtttattgtaagaccgttgaagctttattgaatggtggttgccattagctaaatcagaaaaatggcgcttccatctcttatcaaaatccttagcgcttccaacgtaaatcttattattcaacacatttttaatctgataaattccacttttcataaacacctctaaattatagaagtatttattaaatggtagtcctacacatttagcacgggattgtctactatagaggttccccgtttagatagattacaagtataagtcaccttatacccaggcctaaattaacccaagaaaacatcgacactacgttgataccactggaggtccagaaacccattgcgtacgttgaactgatatatcatatggcatggtggaagcgccatcttagggatgtctagagggttccaggcagtcacaatttgacgacggtcattaggcagttctttaattcggtcaataaccaaagtcaattggtcaacacccataaagtctcgccattgcttaccgtagacaggaccaagctcaccatcaacgtatcccattgaacgagcttgattttcgtaattgtcatcccagacagttttaccatttgtcggagaaccatgctgacgaagacgtaaatcgtttacatttgttgaaccagataggaaccacaaaagttctgcaatacatgctttccatgcaagctttttggtggttactgctggaaaaccttgttgcaaatcaaaacgaagctgagtgccaaacacagcacaagtgccagttcctgtgcggtcatcagtcacgtaaccttcatcaaagatatgctgaattagctgttgatattgtttcattattttcctgggcgaaagaagatttcacggccttgtttatcaaaccgaccaaaaacagtcatcgtattaccagtgatgactacattacctttagcaatatgatgaattgtttgacgagtgttcatcataattttaacacctaatccgcgagcaattctgatgccttcatcagctgcccaagtgtcattgatttctacatcaatacgatacaagccatgaggaattgttttgtataactcaggctttcgcttatattgctcaatagtaggagcattaccctcgattactaaagcccaattcttttgggcttcttcttgtaacagagtcaaatgattattgattttcatattgttcttccaatggattgaagaatacttgacttccgcttttaaagaaatctccaatcattgtaacatagccatttgaaaagctaacattaccattcattgaagcaagtagtactgatttcattgaacgacaaagttcaattggattatttccattgctgtcatagatagtgtactctgcattacgatattctctgatatcttcaattgcaaaggataactcatacacaccgtgaactttgttccagtttttccatttcttttgagtcttgtacgcttctaacagacgaagattataccctttcatagaccgtctccgtcagtgaagtaagttcatcacaacgaacccaagacgtttctaccatttgaaacgcattttcccaagatggatatgaaatgaagctcatgtccagagtgacatcagagttaacccgatgtttcttctgtattgacgtttggataatacggtctgcgtatggctgagccgtctctagaatcctcttgccaccaataactgaatagtcgtcattgggaagaaaacgaatacggtcaccgttgatgttagaataatagcaattcgttttatccaggaaagctttgaattcttctggactcatgtaaccatcagcaaataaaccatcctttgcttgaacaaagtggcgattaaggtcttgaataacaatgcacttacggcctttcaatgccgtaggcatactcatccaggttttagcacccataataacgacagtgtctttagtgcgttttgcaaagttttgcatgtcacgcttgatatgaccccaaggcagaccatctttaagcccaaaagcatattcattttggccattaacggtctttgttccgcaataagcataaactaattgaagcatcgttcttcccaccattctagagcagatttagctgttttaaagatatcaccatcaatatatgtcataccattatcagcataaatggttaaagcaatatacggatattgagattcatttgcactgttttcaagtgcgtcactgaaatgttctttagcgatatcaaccgagttaacactaaaagccacttggagattatattcaccctggtcatctcggtattcaactacagtaatcattaacgtacctcgatataagctacgtcagaaggagccacatacatatccatttcatcacatgggtcaccaagaacaaaacgataattattaccgcgaccttggaaccatgctaattggactgtatgcatttcgccgtagatagtttcaattaagaaaggcttatcataagcttcgtttgcataaagcgtgtcaagacagaaatcaggtccaattttaaccagacggatatctttgtattcgagtttcattagccttgcctcattccacatttaaaacatttaccgccaaggctccatagcccagcgccacaatacttacattcccagtcggttaaaatccacatgatttgtaaccactcgctttaaccatttcacgaagacgatcttcagcagcttcaagagcttcaggattatcatcatgaatatagaacaaccacttaccacgattttcagaaccaagtttaatgctttcacgttgaagtttcattttattctcctttgttttgatagggctatagtaacacaccatagccctgatgtaaacggttagtcgtctacttttagcaactttttgaaagcatcaaatgatttcatatgttttggttcaagatacacatgcttaaccatcttgccttcaagggagaagacttcaaccaccatgtcataacattcgtcttcaacgagatgcatgcattttggagtagaagctttgtcaaacagctgtactaagttgtttccagcccagatgtttttgctgccgtcgtagctataatcttcagaaagaacataaaacattttaatctccaaagggcccgaaggcccattattaaaattaagcagtgtaatcttccatcatttccatgatgaattcataatcttcttcgtcttgagcataaaaattcttaacccaaagaccgatgtctacttgatgaccaattaatttaatttctggccaaccgccgccttgaccactttcatttacaacttcaaatttcaaaccactaaatggactattgaaacgagagccgtcatcaaactctaaatcaactactttaccgttttctttaacgagatcgcatacaatgtcaattacaagttgtttcattttgatttactctctgttgttttgatagtgctataataccacatccatgtggtgatgtaaacggttagttgcaaatttcagaaatagtgtcagccaagaattcgccagtttcgtcagcgcctacgcagtaagattcagttaagaattttacaattttctcacgaggaccgaatactttgtattcatatccccattctacatcgcctgctaattcacagtttagaccgaatttttcaacttcagcttcgaaatgttcttcatctgcaacgccgagatagatatgtgccattttgttttactccgtttagttggtgtaagagtatagtaacacagcttaaagcggatgtaaacggcagaattaacgtaacgtaaaagttactttaggtgggaattgggaggttaatgtaacgtaaaagttacttagttcaaaaacaacaaaaggagcccgaaggctccttctttttattacagaccattcagcagttcgtcgaggtcttcatcaccgctggaagcagaaccgccagtttccatgaagtcttcagctggtgctgatttctgagaacctgcattaaagttcgcgaggtcatcttcaaagttttccaggtcttcaccaaccttatcagcctgagcagaagcgcgagacgcggcagtacccatagcagctgtacccataacctgaaggaatttcttctggttatcttcgaaagatttgaactggtctttcgcagtcaaagtagacaggtcaaccatttgttcctgcagctgtgcttgataagcttcatcttcgatgttaggaatctcagattggccaaggaacttggattcatcatagttgctgaaaccagatactttcttaactttcagaacgaagttagcaccttcaaacgcacaagttacgtcgattggagtttcgcccatttcaacgtcaacggcaaccattgcattgattttgtcccaaattttcttaccgaaacgatatttgaagactttaccttcgttttctggagcagccgggtctttaacaaccaggatgttcgcgtagtaagaagttttgcgtttcaacagcttgtattcttcgttgttggtgttatatgaatcattcttggacagatattgacatactgggcaagaatcataatcaccgtgggtagaagtacagttttcaatgtaccatttaccacctttcttgaagccgtgattcaccagaacagcgaatggtacgccttcatcacctttacctggcaggaaacggatgaccgcttgaccgttaccagcattatccaacttcagtttccattcacctttatcttcggaattgaaacctttagaaccagacagggaagccagttgggaagccagggcagcaggatttttacgcttaaacatagattttaccttaatatttacagtttttgacagtttttatgaacagttgttttgcttcttcgcggtcaacattaagtatctttcgatacgcatgtaactttgtagagtagtttgaccagaccagattatcggttgcttggtcatgtttatttataatgtccagaaacgagtccagaattataaaagtctcgaaagagatgatattactttgaagtaatttgaatatgtatgacgagttaaccttatcattataatcaaataattcattaagcgatttaacttcaactttcttgctgaaatagtaaatattgcgaacatcttcttcgaaattcgacttgattaatttcagcttaccaatatattcacgataaaacactaacgcatctgcatcggaaatttcaccaatccaagcgtcctggttagctaccaggttactgatgaatatcaaggtcaattcttttaatgtgtatttctcagataacttcttgaagaagtatttgtcacgacgtttatcgtaagccttatctgatactcgcatgcaccagttgtacttgacaacatcatatcgaccgttgaagtgattcttcaacatcaagtacaacttgtacacagacttaccgtcgatatatcgtccaccatttggtggcatgcgcaatttaatcataacaggaaatcgagtgtatttgtcttttgctgtttactaaaagatggacgcaatagattatcgtccaatgcttcgctcataatcttttcaattatattaccaggaatatatttagcgaatgcagtttcagggaaagaattttcttctaaccagtgtgtagcagcttcaagataactcattccatgttcattaactaaagcttcgatagcgaagccattgttctgtttatctactaatgtagtaacagaatccggcttttcagccggagtttcatcatttagggaaaacagtgtcatacagctcaatcgcctcttcagtttcagcttcaaattcatcacgagcagatttgaagtacagagtcagcagtcggttaaacatcttaccgtcaacgccaagttcatctttggcacggtcacgaatgtctttgattagaacctggaaaccggagattttcagtttatggtcggcagcttcaacaattagtttcttgaggtcagcaccatgcactgcttcgtcaaattcaactggttctttcttttctttagccataatttcctcagaaatcgttaacgtttttggttaattttgaaagtcctgatttcacgaagtaaggatagattttaccacgtggaggtactttataagagttataataatccagaatttgattagcaatatcttctggaatataatcgaagtcgataagcactcggttttcatagaaacgtttgagctgctcaccttcaagaacagttgtgatatcttcagcatcacagcattgttcaacaaatgcagttttagttggtggagtacgttcaccatctacgcgagtataccagaagtcagaacgcacagtaattgctgctacgttatctttcttatcgcctttaactactttcatcatgcaatcaagtgcaggagaacctgtcttcgctttaacgaatttcttctgcattggagaccactgagttacattcggatatttgtgcaactgagtaaagtcaccatctgatgaaacgataagtactttattaccttctaacgaaagctttttagtgaggacggcaatatggtcatccgcttccattttatcgatattcatcatatgataaggcatgtacttttcaaattcttcaattacagtgcgaataccttcgaagtaaccttcccagtcccattcagattcttcacgaccatctgcacggttctttttgtagtaataagctttatcgcgtcgccaataaccggacttagcattatcacaacaaataatcaccttgttgtaaccgtctttacggaatttgaatgcgttaaatttcagagtgctcaataccagatgacgaagcatcggagtagtgattttctctttatctttgaaggtgtgcatcgctgtcgccaatgcaatttgagacaagtcgactagaatgtaaccatcttttacctggtcttcttcgtcgaacagacagtttaaattagacattagaacctcgttcatttagtaacagagtcattataaataagttctataatagcaaataggagcaccattatggcagattcaatcaaacgcaagtttcgtggcgctgaaggcttcgatgctgcgggtgaaaaaatagtcaacgttgctactgctgaccgcacggtgttatccgatggcgtcaacgttgaattccttatccaagaaaacacattacaacaatatgatgaaacacgtggctacacttctggcttcgcagtaatttacgacaaccgtatttgggtttcaaatcgtgatattgcaaaacctgccggtgcattcaacgaacttttctggaactcagtacgtactgatgctaagtggcgagtagtttcaagtggaacaactactctgaaatcaggtgaattcatttcagtcgacaccaacaaaggtaacgacatggtattcactctgccaagtaatccgcaggacggcgatacaattatgctgaaggatatcgggaacaaaaccggtaccgttggtgtagttatcaacgcatcagtacaagatattgttctgcgagacccagcaaataaagttcgttctgttcgtatgactcatccactgtctcaatacgtgtttgtattcagcaatagattgtggaacctttatgtttctgattatgctcgttatgctcgcattgtaacaccaagcgcagttgtacaagctcaatcaaatgatttcattgttcgtcgctatacttctccaggtccaattcgtgtaactttacctaagtttgcaaatactggagatatcattaactttactgaccttgatggaaagaaccctcaattccatatggttgtaagtacttttgatgataacactaacattggtactgttggtcaaaaatcaatagaagttcgtacgtcaggtgacggattcatcgtatatgatgcttcagaatcaatctggagaatttgggaaggtgatttacgtccgcgcatgcgtgtgataaccgacaacgtaactttaattccaaacgaagttgttactgtttttggtgtaaataatagcactcagaaaactattgatataactttacctactgatattgctgttggtgatactgtcactattgcaatgaattatatgcgcaaaggacagaaagtaaatatcagagcagctactggagataaaattgcttcaagtctgcaattattgcaattccctaaacgctcagagtatccacctgatgctacatgggtaatgaatgacgtacttactttcgatggtactacctcatatgttcctgtacttcaattatcttatattgaaaacgcaggttcaaaatactggattgtagcagataatgctccgacagtagaacgcgttgattctaaagacgatactactcgtcagcgtcttggtgttattgctcttgcttctcaagctcaagctaacgttgattatgaaaataatccagaaaaagaattagcaattactccagaaactttagcaaaccgtatcgctactaagattcgtcgcggtattgctcgtctggttacactgactgaaattcaggctccaacttctggcccgcatctggatgatgttattgttactccagctatgctgaatgaaaaaacatctactgaagaaagacgcggtgttgctgaaactgctactcaggctgaagcaaatggttcaactgatgatgaaagaattgttactccgaagaagctgcataaccgtattgcttctgagacgttgactggtattcttaaattagtaagaactgttgggactgcggcgggtattggacgagatacgaaaggtactaacatttatgactatgataacaacattgatgcggtaactccaaaatcactgttccaattcaagtctactgagcaagctcagggcggtgtttatcttgctactcaaaacgaagtaattgccggtggtccggcacagcctggtttccctgttgtagttactcctgaaactcttcatggtaaaacaactactgacggaagaattggtcttattcagattgctaaacaaactgaagtagatactggtacagattacacaaaagcagttactcctaaaactctgaatgaccgtaaggctcgtgaagatttaagtggtattgctgaaattgcaactcaagttgaatttgataccgggacggacgatacacgtatcgtaactccattaaaggttaaaactcgtttcaattcaaccgatagaacatctgttgttgctctgtctggattagttgagcaaggaaccttgtgggaccattatacattagatatcaaagaagcatctgagactcagcgtggtactgctgctctggccactcaggtacaagttgatgctggtactgatgataagacgattgttacgcctaagaaattgcatgctaagaaagctactgaaactaccgaaggtattattcaagttgctaaccaagccgaaacagtagccggtactattgctaataaagcagtttctcctaagaactttaagtatgttgtccaagaagaaaaaacttgggaatctactatagctcagcgcggtttcgttaaattgtcagaaaaagcactcacctttaagggtgatactttaaatggttctggtcgtctgcttccaggtgatttaattaacgaacccgctttaacagatttgcctaaagaaggttatgcagtatctccatacgagatgaaccgtgctctgcaatacttcttgccggctaaagcaaaagctgttgattcggatttactggatggaattgattcaactcagtttgtccgccgcgatatcgaccaagtagttaatggcaaaattacattcaaaaaggatgttactctagaagctcctctggtgtcctctagtacggccaaattcactaccgtgaatgctactatatctgttgatattggtgattctctgggtaattctagaatcaatttgaatactctggcgaatggctggaacattgaaactctggcgaatggttcaactcttgattttactgctacagataaagttctgacgcttaatcgtaatggaaacgtaacggttgctcagactctgacggcaatgaacaaagttgacgctaataagggcttttcagttgaaggtggtacaatggttatcaatccttcctctactgaaattgtcattggtactcaatctaagcaagtaacattgcagaacaaagatgctaagacattctcagttgtagacccttctggcacttacaccattctgaataccaagaatgcttttgaaataacggctcaagggttcgttaagaaagcaggtgattcaatgactgggccacttcaaattcaagctccattgactgttcagattcctgaaggacgagttgctcctgatgttaaaccatcagatgataacccagcttcatggtctgcatcaattacgtcagcagcaatttacaataaattgcctggctatggtgttccagttatggaaaaagatgctgaaggacaagacaccggtttcgtagatcattacgaatatgttaaaggtcctggtgtattaactcaacatggtattggtaagactgcggtctatcaaatttgggcgcctcgcccaactgcgcaagagttaaaccacaatgctcagactttctggattcgtaacttcaacatcgtcactggcgagtgggacgaatttggtaagatgtacacctcagttcagagacctactgcaggggaaattggtgctgtatcaacttctggttcagctttcaataacttgacaattcgcgattggttacagattaagaacgttcgtattgttcctaatgaaactactcgcactgttgacttcatatgggttgatgaataatggctaaaatgatggcgagctttggacaaggatttgtccaaactcaagttctctctgagaacaattccgtcaagtataagctagcattcgctgcaggggtagctcagtctaccccttctgaagcttattatactttccaggatgaacctgctggtgttcaatatgacggtcccggcataaatttgagagagtttaatccaactaacaaccaaatgattaacttcaagacttttaatataaagcctgaagatacaaatgctggaacaaaagcgtttgtcgatcatatgaaaacattagtatcttctgacaatttgcttataattacttcatatgatagattatattcaagcccgtctgttgaagcattaatgaaatcaattggctcagttttatggccaagcatattcttaacgaccaattatagttgcaattattgtgcattgtattctataaatcgtaaaaagataattgctgaaaatgctacttactctgatttcaaaaaagaagacagagacattaggccagcacttgaattcatttatgataaacctagtgatataggagctaccggatattctcaaaaagcaattgatgaccctgaaacttatatcattaataaagataatactagtaaaagatttccacggcaatttgaacaaatatctccaataagcgagtatggaatttctcctggagataaaatgcaatggaactttgaagttaaaggtgatgcttctttaaatgctcctggacaaaatattagagttaacttaagatggtttaaaggaagctcttatttatctggagctgtagtcgaaacaaatcctttagatgcagacaaatgggcttggcatcaaagatatgtcactgtaccagacactgctgatggatttactatcatagcttctcgttatccagaagtagctggttctgaaggaagcggagccattagagaaatgatgcttactcaagtatcaagattggttgaacctcttatggacccagccggattcggtgtcaatggtattcgtatgaataatatgatttccgatggagtaaatgaaaatactctattagtccttcctgatactgaagatgataagtctggtaatatctactcagctgacttcagagagtataatgactaaagcccttcggggcttttgttgtttctgaataaatacaacaaacacataaggggaaggccatggctgatttaaaagctaacagtacaattggcggattaccgatttggcaccaggggaatttccctctttttccaataaacgatactctgctttacaagacttataaagtctataccgaatacgacaagcctcaagctgtagataacgactttgtttctaaagctaatggcggaacatatctgcagtcagttaactttaatcaaggaatgactttccttgatagcgctggtgctgaagttacaataggaaaagcaactggaacattaggagcaacctatactgcttcaattaaagtacctgctcaatttgcgtttgaaactggtgaaggcaagccttttgtaatttttgacccagttactgatatgactaagcctcggcttattgtgatgggagatgtcttaggtaagtttttatatgatgaatctggacgagtttattcacctggaaataaacctaccaatgctgacgttggtttaggtaatgttaccaatgacactcaggtgaaaataaatacaaccgaattacaaacaatgacaggttcattagctgccccgaacttaagttctttaaatgcagcttctgcaccacaacacgttcctcgttttgatcagattgtcgtaagagattctattcaagattttggaacttattgaggaatttatggcaactatcaaacaaattcaatttaagcgttctaatgttgctggtaaaagaccgcttcctgctgatatcgcagaaggcgaattagcaattaacatcaaagattccacgttatttacaaagaacgctgatggacaaattattgacctcggttttgctaaaggtggtaaaatcgacggcgacgttactcaagtaggtaattacaccacttctggtgatattagtgctaaaacctttttagcctcagcaggtgtttcatcaaatggtgatattgttgctgaaaggggtgtaattagaactcgtgctgccgcttcaggcaacgctcatttatggtttgaaggcgaagaaataactggcgaaaaccgtaataaagaacgaggtgttttatatgctacccaacaaacagatacagatgggcgagtaaaccttcgagtttacaatggtaagtcccatgcggctaatacaaataacgcactgtttgtgttcaatggtgccggggatttcgcggctccaagagatttatacgctcaacgctctcgtttaagtaatgagtctattgctcctacgatgaatacttcacgactttatacaagaaatagagcgtttaacgagtttggcaccaaccaaagctacggctgggacgatactgtaaattataccgctggtcagaatggagccattgctctgaactatgtttataagggtagggctcacgcatcaggaacaatttggcatcagctaattgatgagcgcgatggcgccgattgggctatttatactggttcagggcctgaacgcaaaatgtttaatatacgttcagctggttcactcggccacgcgcaatttacaggaagtttgttcttagggtctggtggcggtggattgggtgttatttctggaatgggtgaaggttctttggcattaggtgataacgataccggattcagaaatgatggtgatggcgcgtttagcgtaatggctaattctcgtgagttaattaattacagctcatcagctgtcaaataccaaattgaacacagaaaagcaactagaattactcacactgataatgctaacacaccaattttgccatctaataacaacccattattagaaattgatacttcgttagattccaataattctggcggcaatggattgactttattaggttataattccggcgggaaatattatcattattttcgcggaaatggtaatgccgtatttgatatgtctttaggcgttagcattaataaaggcgggttaaatgttaatggtaatagtgcattttccggtactttgtctgcgccgcgttttgatgcattaggtgatatttcatttaaaaataccgtgaatcgccatattcgttttgaatatacaaattcatccggtgcaactgcagtagatggttatatttttaaagatggacctagcaatacttccagacgccctggtattcgtgttaactgcacggctcctaattccagttccggttcaggtgattttgtatttggcgaagatgggcattttactgttccaagacaagttcaaccaggcgattttggtaactttgattcacgttatcagaatttgttccagcttggtgcaaacgtaaacttagatacgctaactggtgacagccaaattggtgaatatgctcagcacgctaatgctaatacttctttggcattaaattatcctgaagcacaagctggtcatttaactattacttctggtgcgggtgttcaacaaagataccatgtttataacagcactcgggtatatttacgcgctaaatatagttctaaagcatggcgcccatgggaccgagtgttaacagaagattatttgaaaactggaattcctcttcagtttgtatctaaaaacagcgatggcttccgtattgcatatggcaattatggtttctttatcagaaacgatggtggcaatacttatttcttgttgaccaactccggcgaccaaatgggcacctggaatggtcttcgcccgttaacaataagtaacacaacaggtcaggtttcaattggcactccattagttgttacccatgcttcaggtattaacgttactagtacagcaggtgatgctatttcctggggtaacgctggcgcttgtctggcaaacgatggtaacttaaaaggctcgcgttggaaatcgtttggtggttctgaatgggctggcgatgctttaagctgggttaacaataataacgttgccaaatctggcgataccatgagcggtatgttaacaatacaagcgaatagtgatgcacttcgtttaaatgctacggcttccaaccaaagtgtttatgtattaggccaacgagcaggtgtcaatggtttttatatgggctttggcgggtcaggcgatgatttaactctgcataactatcttttaaatactaatattaacttacgcgcttcagatattcaattttcaagaacagtatatggaaatggcgacgcaaactttaacaacgtttatattcgttctgatgttactttaaaacgtaacttcaagaaaattgaaaacgctcttgataaagttgataagcttgatggtttgatttacgagaagaaaaacactcctacttcaactgaatatgagtctgtagaagctggtattatcgctcagagccttcaggaagttttaccagaagctgtcgttgaaaaagaaggtattttaaacgtttctgcttcaggtactattgctctgctggttaacgctatcaaagagcttaaggctcgtgttgaatatcttgaatcgaaataatgaaaggggcttcggccccataaggatttaatatggctgtaactggtgtaccaggttggataggtgagtccgccgctcaagaaacaggacaacgatggatggcccaagcggggtctgctttaagactatcaactcctttctggatgtctactatggcagggcgctctgtagaaataacgataactttaggttctaatcatagttatgacagaaacgacttgattactaaacttcgcgcattgggttctaccccagcggttgttgtaatttcgggtgatttggttgctcaaaatactggtgttccttgtttagaatttccatctaacttaccaaatgaatatgttcatttacgagttaatgctaacgtatatggtaggggtggtgcaggctgtagtaatggacaaacttcaggccaggcaggcggcccatgtattttaaacagctttggtactcgtcttcgtatagaaaacaatgctgcaatttgtggtggtgggggcggcggaggcggcgcaagaccaggtcaaaacgtggtttctgctggttctggcgggcgtccattcggtccagccggtatagcaggtggacgagattctaaagatggatacgctgctacattaactgcaccaggcccaactccgccaaaaactcgttatggaactactggtggcgctggtggtgatgtaggacgtcctggtgcacctggtacaaacgatggcggtaacattaccaactatccaggtggcgcagccggtgcagcagtatatggaaatgctccaacttggattaaagttggtaaaatttatgggtcacgagtttaaagcataaatacccttgaaaaggagggtatatgacccagagaacaccactaccaggaatatctgacattttatttggtgttctagaccggctcttcaaagataacgcaaccgggagggtactcgcttcccgggttgttgcgcttgtagttgttttcattctttcacttacatggtatcgtttagattctattatgcaagtgtggaaagagtctcgttacgagacgtacactaaagtcctgcaacaagataaagaggctaaatttgaagcatcagctctagaacaacttcagatagcgcacgtgtcgagcaatgcagatttttccgcaatttactcgtttagaccacgcaacttaaactactttgtagatttaattgcatatgaagggcgactgcctagcgcggtcaatgaaaaaaatttaggaggatttccagttgataagacttcaaacgaatattctgctcatttgagaggtgcatatttctcttctgaaaatgaatttgttttcttgccgactaagaaaaaggatggggagttgaagtacatgtactcatgtccgtatttcaacctggacaatgtatatgccgggacagtttccatgtactggtatagcaaaccactcttaaatgaagacaggcttgctgcaatttgtggacaggctgcaagaactttaggaagagccaagtaacaaggatgttacggcttgctatacatcatcatgtaacgatacactgattcaaaaccttcattaaactcttcaactagctgttgtttttcttcagctgtcatttcttcaatcattttacggaagttactctgatttagaggacgacctaaatcattcttaattccaatttcattcaaaaatgcaataaaatgttcacgtttttcaagaatgtgttcagaaccaaatttaatcaatacagaagccacagtaacaatttcgcgaacaatttcaattttagacatatcaagtatttcctacgacttaatggattgaggatatagtaacacagtcaacggtgaatgtaaacggtcagttcaccacttcccagcgttgaagtacatggccaggtaaagttacgtattcgtcaccagagtcatagcgaatggcgtagcgaccatcaatcaactcagctgatatataccattcggctcctactacacgaaccctacgtttcatccagtgacaaatctccatggcctcttgatagctgtaatctaccatgtcaccaagcgcaagcttgttcatcattccttcgagatagcgttgaatctctactgtctggttcattaaattttctcgtaattgattttcaattcaaattcgtcagcaacacctttgaggaattgataaccttgcatgacatcagaaacactacgcttagaacttacagtgaaataacaaaatgtttcttcacttacttttatttcgcaatgagtgagtagagattctggatgattaacagcatttacaaatttttgaaatgttgtatcttcaaaatatttccaagagcaatcttggtcatctcgagtcaaagagaaccataccacaagattatacacaggagttattgcatctacaacactggtgtgttcatcccatgctttacgttctgcttcgatatgagaaattttattcataatcttttcccttatgtttttgcttacgacgagattctttttcctggcgcttcatatctttatgagcgccgcctttattgaaatcatgctttgctactggattgttcatcttgttcctcgagtttcttaatttggcgttcaagttctttaatcatttcaaggttaagcataacataatattgtgcaaacaatggcttaatggttccattccacatccatggatcattattaattgtcagcttcttcacgacagcttctgataaccaagaccaacctgattcgtttgttaatgaagtccattgttcatgcatcatctcatttgcttttttaagagcgttgatttgattacgcagagattcaatttgaagcaacttaatatccattttcattagtataaatcctcggagaataatgtatcagcaggcccacttttaacacgacgagtattaatttgaccggcatgagttgcaatgattaatgcttctttgcgagtaaaataatttccccattggtccaagaaaccttggtcatcaccataaacttgttcagaaactactttatcacgcatttggtctaacaccagagccatatcttttgaataatgacgagtccctggaataactaactctccgccatctttcaatttaaaacgattagctgcacagacgataactcgttgaagtaaacgaccatcccaccaatcggctttaacgaaacagatttcaggaatccgttcattgacattctgagtttcgattaaatcaccattcatttgaaaaatcctttaattttctgccacagagtttttggttcacggattccccaaacacgaagttcaggttctttaactacttcgttaatccattcttcaacttcttcaagctctttctttgcgatgacaacagaacatgaatcaatgaagcgagccaacgcctgcatataagttgcacaatcaccgcagtgacgacctaaagaactgtgaactgcatagcaacctttgtatttacgttcaatactaccaagatgtgttccacggaaccagacttcccatgcttctgttggtaagtaatattcgtctgttactcgttcagcacagcgttgaagttcattcaaaatcgctggacgattcattgacttttttacgcggtcgatttgagcattcaggtttttcatgttcatctttaatttccttattacagagtgtcaacagcgtggatgatgttttcaatgttttcctgagtacgtggaatgtccaggtatacattgccatttttagaatgtttagcaaccattccgaggtcttcgaagtgtttaacttgttcttcagtcattttgtaaccggagatacggaagttacctttgtttgatacctcgaagctgcgaataccgaaagttcgtttttcgagtaccgcgatgaagttgctacgatagacgtccagttttttgattgtgaacagattatctttggtagccagcagttccatcatcagatttttgtctgcttccatctggtcagtaatcggacgagctttacgagtgttacgtttttccagaagttctggtgcattttcttctgcgtagataactgctgcctggttgatgatttcttgaccttcagcagatacaatcagaccatcacctgatttttcaatcagacctttcttaatcagaacaccgatgttgctgttaactgaagcagctgaaagtttatctgccagaacgtcacgaacttcggaagaagtaatgaagtctttcttagcgactacaatcagaacgtttgcagcattttcagagatagagttttcagaagctttaacgatatagattactttagacattttgtttctccaggttctgtatttgttttgatgagataatagtatcaaacttttaagccgatgtaaacggttgttagtttagcaccttccgaaaaagatgctatcaaacagcttaacctcggaagaagtctgcgaagagcttcttcgcttcgttcagagtttcagcaacatcttcaacttctgcatcaagcactgcagtcatgtcatagttgttgacgtatacccatatcagcacgtagttttcgctttcgctgttataccaaattgtcagatagctattgctatcagtgtttgatgagtgaaggcgtgctgcatgcattgcgtcgtcaaggtcaacacctgaattagccagtaaagcatttaagttattgattaaagtttccataatttcctcattttgaaacataagcttctaagacttcttcaaattcgccttcaagttcagggcatcctgcgaaatctgcctctaaagtttctaaatcaatcagaacttcagttaaaatgtattgactttcattatggtcataaaccatagcccaataacgtgcttgagtattcttgtcaattgacattctgttaaatttaacataagcgaaatcagaagtttccgcgataataccagcatttgttaaggcagcaacgataattgaaatcattttgtttactccgtttggttttgatagagctataataccataagcaaacgatgatgtaaacggttgagttaaagaatttttaaagttaaccagaacggttgagggattgtgcgtagaaaggatgattaattatatggactcggctctagaattaactagagccgtttagagtgatacagaagatcttagagagcctccaggtccttcatatactcaatttctggagtagtttcttgccagtactttagctcagctttcaggtctttagcttgttgagcaagtttctttgcttcgtcacttgtgatgtgatagatgttcattgacactaacttgtcaacaaatggtgcataagttggactagattcaagttcagaagtcagttgcttacgagttttaccttgaatgacaatactaccttcaatcacttctttgatgaacatcgcttttgccaaagcaagtttgaatgcttcatcgcattctttgattttgtgttcaattcgtttaacgatgtaagtcttacgaacttccacaaagtgtttgatgagttcagaagaactttggaacttatcgttcaactttccgttttcatcaatgactacgatgaactgagacattttctcaaccaatttgaaatcacgcatgattttctcgtggcgctgttcattatcttggccaagcatatagtcgtctttcttgaacttaactttaaagccgaaaccggtctttgaacagtcatctacataagagatgaagttcttatctaccattggctcaagtactttttccacataagtttcacggtcaaacttagctggaatttcactgatgtacatttgagatgctgaagtgaacttataaagaccacgacattcaattgacccatcttcaagacgaactacttcaccgcggaattgtggaatttgaacttctggttctttatccagctttccttgaagagctaatttagtgcattcaactacagattcaaaactatgcggaagaatcttagtagcatagccagttgcaattccctgtacaccgttcaaaagaacagttggaataatcggaagataaaacgctggtggaacatgctctttatctttgtgctcaggagcaatttcagtgtctttatagactttacggaaattgtcagaaatacgacagaaaatataacgagatgctgccgctttttgaaccagacgagaaccaaagttgccttgaccatccagaagaggatagttgttgttccacgtgttagccatcagtgcaccagcatcttgagctgaaccttcaccgtggtgataaccgaggtcagcaacaccgccagctacagaagccagtttgtggaatttttctttattaccacgagacaaatctagtgcacgagcaataacaaatcgttgaactggtttgaagccatcaatcaaattaggaattgcacggttttctactgtgtagattgcaaattctttagcttcattgtcaatgatacttttcaatccacgaactgtaaaagtatcatcagcctgtttagccatcatgtcaaaaatatctgtcataatacctaccaaattaatgaagagagttgtactataacatcagaaatgaaaagcacaatagacacgagcctgtaaagaactccataataaagaattaatgccaaaacagcggccactaaggccgcaatcagaatctttttcataatttaaaaattacaaaataaaggattaaaattgacattatcgaggatgatactgctgttactggtaatgcacctgttgcaaatgataatgccattacggtccaaaaaattattaaaatcatcttaaacattaattttttgcctcacgaatcagggcacaaatacatgaaataacccaggcaacaaacataaaaccgataaacgttgctgacggaacccatgcacctgtgaagtaacatatagcgcaaacaatcgccgcgattaattcaataaaagcgataaggaccattatttaatcaccccacataaaatagccagacgttctaaagccaggatagccacaccgtatgcaaccatcccaacaataccaggtgtaagaggggcacctaaaaacaagaaggtgcccactacaaacattatgcctatcagataaagataggccatacaccttaaggcatccattagtagctctgcagaatgaatttgaagttatcattcagcatacgattcatttcttccaggttctggtaagaatcgttgtgtttacgagtgaatgccagagccaattggcctttaccaaaaccagtagtcagaggcttcattttgtcagctgggatgaagtacacatcgtaaatgacgttatttgaacgcatagtacggcccagctgagaacgaccctgacgaatttgtgacagaacgttcaggaaaccagacttagaacgctgacggccgacgtagaatcgtgctgctactgcacgccaagctgaagcacctttaaccatgaagtagaaaccaggttcagccagaacagatgggtcaacatatcctacagtttcaccgtttttaacagtacacacaacagttgcaccaacagcttcaaggtcaccacgagtcatataatcacgcatatcattttcctcaatcaattaaaagcccgaaggccctaaattaaagctcagaaccttgctgaacaccattcattaaaacttctgcaacgcctttcaaaccttcagtttgaatgacatgaacgatttcaacagtagcccaaatgctaaaaccaattccaacaaaaaccatgatagctatgatggaaaagaaaatccagaaaatcttttccattttatccatgcgcgagctataaattttgcgacccataatattttcctcagaagttaatccatgccattacgacatcatgtgctaaagcaaatgcgaaagctccaaagagcaccatcagaagagttaaagtccagatagctttgaaaatctttttgatgatgttcatttgtttctccgttagttgatttctagtctatagtataccatctaacggaggatgtaaacggttgagttaaagatttagataccagccctggtagttgctcttacgaacaactgatttgaggtcttcgtggtctccagcaaactttatggtaaactggtaaacaccagacgaactttctactacatctaatatgataatacagtccgcgactctatgtgtcaagaaaggtcctaggtttatccctgagccaccaggatagtctcctgaatagccagtggtgacagaaatccattttgaatctgattgatgagttttgacctcaatccggagcccacaaaatcgaggatgagcaagaacgtcccaggcataagtgtaaggatcgtcatgattttcctgaccgcctgcaacatagccatccatccaatctgctacagttcgttcagcaagttgagcaattgcacatcgcttatatactgcagctttatcttggtcagggtcttgacgcatagaataagctgcagtatccttgattttcactctgtcacttgaagttaaactactgaatgacctggtaaaagtcttcagggctttcagtctcatcaaccctggattcgattttttcatattcaccttcttcatttttgaaaatagcatctgtcacgtgtaaagtgccataatagattctgtcattatgattgagtttgcttaaatcaagctctttcaactcatcttctgccatgattactacatcatcacaatacagacaacccgatgctttattatctcctgcgaataggtctttacaataaacaacacctacataatgattaccatgtaagtaactatttttaatgcttttatcgccaatattcattggattaatcatgacatcttcctcaaaaataaagggcccgaaggccctttcattagatataagaatcagtttcttggttgtattccgcttcacggattactttgtactgacaagtacgcattttagcgttgttataatctaccgggatagatactacgtcacgcgggtgtactttaacaaccaccagacggtcatttccaccgcggaagtgcttgatgtagctacgagcgcaaacatgcagaccagcttcacaggtgagattttcatcttcaacaacatgtgtgcgaggcattttaactactcgacctacagagttatcaaaacgaccggtatagcagtcagtgtaatcgttgcgaataactttccatgccaggaaatgaccatcttcagtgatttcgatgtcgttggcttggaggaagtcaaacagacgagtcactgcagttttgcttgggttttccagcagattttccaggaacggcagatagaattcaaaatcttcaccattctgcatatcattgatgatgcggtcaaccagaccagatttgatttcaatgtcctggtagaacagttgaccattttcaatgcgaatgttaccgtcaacataagaagtaattgccttctcaatgttaatcagattaattgcttcttcaaattcgccatcaacacacagctgaagagcttgtttgaagttcggatggtctttatctgctgcatatgtatcacgaccataagtgatagacaggaacttagaagaaccggcccatacaacatcttctggtctgaatggattagttgcagcttgactgattgcattagtttctgcaatttttgcggcttcagtatgaccaacaacagcttcaataccaactgaactagcagctttaatttctttgattactcgacgcactgtgtcaacagaacagctgaagaattttgcgacttcttcctgagtgtaaccacccatatatgcatcatagatttcacgcttttgcgctgcatcaaacattttaacaacagagactttcttactcatcttcactttcaccttttaaggaaggagcgccttccaacgctctcataatacgggaaatatcttcggcataattagctacacgccattcgtttagcatatgctcgatgacaggatattctttctcaaactttttgaatgcagcatctacttcagctgaagcagcatccgtgagtttattataaatccgaacacataaagctaaatcttcacgaatctgtgaagaaccatcaggacttgccgtgatataagtgttcttcaggttgcgtccgatttcattgatacgagatactcgctcaccgttatctttgccagtaatgaacttcagcagccactttaactcaggagtattgatgatgttacttacaacacgacggttaaagaatgtagatggcagatattcatcagcatccaggtcatcaataatcttgatgaattcatcaacaatgaaacggtccaacgattcaagattatcatttaatttagcaaccttggccgagttcggacgaataacgtaaaactcagttacgcctagttctttagccaaagttctgacagtttcaatatcaattccagaccagtacagctcttcagggaatgtacgaatctcatcgcgtgaacggaaaattgcataaccttcaagttccgcaatatcgtccttgttcatgaagaggtcttcagaagtccaccaaccacctttagcatctaacttatgcaattggccgtttggagattttggacgcggtccaccatcacctttagatgagtttgagtaatgctctttctcaaacttacggtattcttccatctcagaagacttcagaataatgatttcgtcttggtcaaacagtttaacgatttcatctttaatcttcatatgcttaggttcttctggattaagcataatgaagttagcataacgatgaaagtctttcagatacattccgcggaacattgctgcgcgtcgtgaaggcttatcatcaatcatgatatgcactttatcattctgaacgttcagcagacttgtcaccgacatacgctttcttgtggaccacgaagatgttaaacgccagcgctcagaatcaatgtttacacggtaagtataaatcattgcatcttcgattttcttttgaatattgtcagtattataaacgttacaccattcagcataagtcttatcgccaaacataatgttctggcgattcagaatagcgcgctggtttgaatcaaattgagacatctgacgaactaactcacgcttattctcaatagactgaagatgcgcaatatcagcttcaagagtagctttttctaagctgttaacacgtttcttgatgttctcaattgtaacatcatccagtgaaagttcttcacgagatggagtgatgtccaattcgccaagagggaaattgacgtaaacacatccataacgattcagaagccaagaacattcaagaccttggaattggtcaatcggataaacaatcttaccgtaaaccgcatacagcccacgaccatcttttccaaatccattaggagaatggaaccactctacatcttgtgggaaagattcaatgttaatgcttgcgccagtgatgattggcttaactggcataggacgcattacataagcaatttcatgcgcaaatttttctacatcttcaagacgaacaggaaccgtaatttcaataccagtctgctcaccttctttcattggctcaacaaacagaggacgaatatcaggttcaccattgttcatcacagccatgtaaccgcgagcttcaccttcgtgataagaaacgatagtgaacgactttgtgtagctgaatggagattttgaaccaagacccagagcaccgatgaaatcgttactttcagcttttgtcgaagcaaagtagctattgtacagaccaggttcttcgtcattaccacgaatctggaaatcactcatacctgggccaaagtcacgaataatgaatcgcgggtctaacttattcggacacttgatttcacatggaacgtcttgctttccattcagaatgtgagcatcaagccagttagttgtaagctcacgaacaacagcacggattttattcttatagagcttatcagacaaaatcataaaggcctttggagaggcctgaatggtgaatttagttttcttaccagcagaacctaaaacttcttcattatcagcaattaatttcatatctctcagtcacagtgtcgttttattaggttagctacatccagaagttcttccgcagtagccgtatcggtgataaaaattttattacgaatttctttaaagcgctctttgaattcttcagcttctccaatgtcaaagaagcgttgaatgatacgatactctttgtaaacagcatcgtcgaacagttcagcagaaggttttaaagttaacatttgatagttcctattgagttaaggattttcgccatttgttttattgtatacttttctcggcgattgtaaaccaccttcaacgcgaacgtccgaaggttcataggaatggtctggcgagtttcaatacagttaacaatataatctattgcctgtttgaatttaatgtgataggggtcatctggtgaacctccatgctcagttagatgtcgttctccgttctgtttgatacattctgctacgttttcaagatttaccaaagttccatcatcaagaatcatctgttcacctcataaaaatgggactcccgaaggagtccctaatcattaccactaagcacgagaaacaatgcctgtgactttagtataagagccgttggtatgtcttacacggatagtgacagtatcacctgggagcggcagagcatctccccacatgtagccgtaacttccatctactaatgttacccaaatctgtgacataatagctccttattgtatcgggcaagacgcccgatatatttattcgctcatccagaccttgcgtggagcagcatcagaacccataaccatctcgaagagttctttccagttttccggaagagaaactacatcataatgaggttcttggattactcgttcatattcgtcttcttccaaagaaccgagccctttgatgtaacgaagtttccaaccagcaagttcatctttttcagcttcatattcagcggcagtgtaataccacttctgtttgtctcctttactcataatgataacaggagttttgacgaagcgaattcggccttcttcaaacagacgaggccaattactaaagaatgccaaaagacttggatatattgaacctgttccgtcaacatccgcgtcagtcatgatagcgatgtttttgtagttcagattttcataatcttcaccaatagtcagtccagtgattgcacagatatcgaagacttctttgttcttcattgcttttgctgcagtcattccccaagtattcaggaacttaccacgaagtggataaccaccatgaagtttacggtcacgagtagtcagaagatagccaatcgcagaatcaccttctgttaagaacagagtggtttcttctttatcattaccataaagttctggcttaatgtgtttagcaaccttagcttttgaagcagcttttgcagctttagtttcagcagctttttctgccgccaatttacgagcaagcatagcttcaatgattggcatatgaattgcttcggacttcataacttgttgagcaagttttttgtagtccaaattcaaatgagctttaacttcaccccacggagatgtcagacgttctttagtctgagaatcaaatcgcatgttgctcatatcacgaacgaacatcacaaaagtaaaacactctttgatacgagctttgtttacttccaatttgtacttgcgtttgagcattgggataagttcatttgacaattcgtcaacaaccaaatcaacatgagaaccacccttagaagtatggatgttattcacgtaagtcagttgacggaaaccatcatcagaacgaccaattgcaattgaacaattatcttcatcagctacaatagcttcttcatcaaattgcttagcgaatttcttgaatccgccattgacttttttgccttggaatttgaattcaatatccgggaatactactgccagagtttgaagacggtcaagaacaattgattcatctacttctgtaagtcctgaactttcgaagtgactgaagtcaggaatgaacgatactcgagttccggtcttggtttgaatgaactctttttcctttgctggcttactatcccaagagatattctcagccccattagagcatcgaacgatgatttcgttttgtccgtcacaagtagctcctgcaaaagttacagagaaaatattagtcagtgcagaaccgacaccattcataccaccagttttgcgttcagcatcatcgccaaagttaccaccggcacgtggacgagtccaagcagctactggtccaggaatttcatcaccttctggagtgactactggagcttgtggaagaccacgaccattatctgttacgataactttattgcctttaagctcaactgaaattttatttgcaaacttgaagttggtacgaattgcttcatcgactgagttatcaatgatttcgtcaatcagcttgattacgcccggaacataagttacactttggaatttaccaaacagaaaacgttcatgagcttccatagctgaagagccgatgtacataccagagcgcttaatgatatgctctcggtctgacagaattttaatttcgttcttaatcatttcatttcctcatgtagtaggagaataatatcccatctattaaaagcagaaaaggagcactaggctcccttacattttttgcatcgtgaatcatgccattgtgcagcagacatcccagaagctagataagcacggaattctttcttcgcttcacgcttttgtttatccgtcatcgggaccggtcgataatacgaagatgctttaccacttactttcatagtgaaaataaatgctgcacttccgttatatggatgtttaccatatgattcatcaattttcattattcgaacctgatagtagagttcttaaagaacataccagagcaaacagcacccttgacaggaatacctgtaggacctttagcagtgaaacctgtagagaaagcatctttatcacaactcagccatgcgtaacctgtgaattcaatttcgctaaatccattagctttaagaatacgctctgcgcctgtttcatctgtgcaactagacagaataccaatagatagaatagctgcaatcaaacccattacaaacactttcatttcttggttaccttaataattttgccgctatgaagtttaataacccggctttcgccggatttcatgaatttaatacgtggacgcgtacccattagtaatcaccgctcttaagtccgtcataatgaactgctggagcagaaactactcgtttcatttcgccttcacagttcaagaatttgcatggctgtggattatctcgctcagaaattttaacattcttttctgatttttcaccacaagcttcgcactgataatcatacaatggcattgacagcctccgaccactttttagttttaagatgaagttgacgattcaactcttcggtaactgcaagagcaacttcttcatgagaagctccgtccattttatcacgcatatgcaaccaaagagcatcaattacacaattaattacatctgcgcattcgccagcaaagatttccttctgtcgatgaggacgattaatccaatcacacatttcaccagtttcagaagaaagctgtaacattacggatgtgatgttgcgccatggtttacgttcggtataattagccgaaacacgaagtactggagtgatatctaatacttgcattatttcttccatttcatagttttgagaatttcaatagcttgttttcgttcaaattcactttcaattctgaacaccatcacgccttcaacttctgccgtccattcttctggttcagaaatattctcaatctcatcttcaagagtcatttcttcatcttcgaaaaagtgttcgttaataaatccaggatgaaccacgtcaaagtatttaagttcagatttaactaaagcgaaattaagcacttgaagagttccagttacgtcacggaacgaaattcttttagtgcgagaataaccacaagtatagtcaacaacttctacagtaaatggctttgttcctacacttaaagcccagcgcttattgattggactaagagcaacaaaagaatgcaaatctttgcaacgatatactgttcctggaacccattctgatgatttttcgacaacatcaaaataattagattctttatcataaagataaaagaactctggcgaacgagttccatctgccattacagcctcagaaacgtcctttccatccatggccgcaacagtaaatgagcctccatgaatttcaataaagcggctaatatcttcgttatacggctctaattcaacaaatgaatcttctaattccgggtcaagacggtaagttaatccaagtttatattctgtggccattagtaagtttccttccagcaggatgaaccgtcttctgtgatttcacggaagaccccgtaaattggcatttcatctttcaaatcagcgaatacataaaccgcttgagtgaaagacagatgatcgttccagtctttctgtacgactaccaggtctggattatagagagtatcttcaaattcacgacctgtgcagttcattgtagcagtagcattaagtttatgtttcatgattttttcctcattggttttgatagggctatagtatcatagccctcaaggaaagtaaacggtttatgcacggcctggacgggcgccgccaggcattacatggttgatgttatctgtaggaactacagcatactcacccatgaacacaacgttggctacgatttggtcagtatcttcgtcacgataaaccagagatacccaagcacccattccggagatggttttaccactggaattttcaagtgcgccatgcaaatctactgaaactggtttaccttcaaacttagcttttgctgtaacaagcgcagagtcaatagggtcattgacttcaacgaaacgatacttagcagaaatcttaaaaccgcttgaaccaagagtaggacctgcaacgttgatgatgtactgtccgcgggctgcattgtcagagataatccaaccgaccagacctttgttctgaccaccaataacttttacacttttaccaatcattttactagccatcttatcacctttcatttaagagaattcaattctaacacattaagttaaagcagattaaccgcgaccttttggtaaagacagagggtcaatttcatcgccttccggtgcatcttctaaaccaagagcataacgttgagcgtattttaacatcaaaatatctttagcgcaatcgtgaatagagtcatgcgcaatgaaaccgtccaggacacccttacgaagaggagttgtcgtcaagtcacgggttaaaagcagagattcaatcgctgtacgaatatctcgctgattccagaacttacaaggctctaagccgaaagtatcgatatctttttcagcaatacctttacgagcttcgccttcacggagaatatccacaagaattgggaagtcgaaagattgaccacgacaccaaccgaaagatttccatgggtcaacaccattgtctttcaggaattgaagcagcttgtacagaccttcaacatggtcaatatcttcatcagatggaagcaggtttttacgagcttcttcagattgagatttccaccacttcatagtagaagcaccgaacagacgaacaccttgttgtgctttaaggttgaacttcagtttcatacctcgctgaacaagttcgtcaaatgtttcaactacttctgggttcgggtcaaatacaaccgcggctacatcaataacagcagaacgagagacgttaccaaacgtctcccagtcaataataaaatctttaatcatgtcatttccttaaattcgcggatattacctgctacaaattcagacagagtaatttttggataatatccagtataccacgaaatagctttagcatctcggataatatcgtttaattccaacacaatctggctacctttcatgttgattccgcgctcagttgtagtagatggatttgacaccatgttatctttgacgccggctacaatagcctctgcgtcttcaacagtaattgtgtacataagcctcacacataataaacatttttacgagcacgagttgtgccaacataaagcagctgttgagctaattcagcatcagccatatgaatacatggagtgtaaacatagcagttatcaactgaaacgccctgtgctttgtggaaggttgagcatggaagtgctttcaccttatgataacggcgcttagcagcccagaaatctttccaaggtgctttaccacctttgttccaatttttgtaagtatcagctgctttagccaagaagaactggaacttgttctgttcctgctcatcagcaattactctgatagtctctctgtagtaatcgtcttcatcgccgtaagtttcaagttctaaatcccaatgacgaaccatgtactcgcctggaactcctttcgccccaatgaaatctgaggactctttacatgaaagaatacgaacatattgaccattgttgaagatgacctcagagaacttcttaccatcatattccaactctttgataagtggttcctgcatcactacaacttcaccaacaataaatggctcttccgtttggaatattcttcgacgaataatagagttcaatttatcaacggatttgttggtgaatgctaacattcggttctcaaacatgtcttccatagttttgacattttcaaagtatgtcatcatgaaatcgcgtaaagcagtttgagaagtgaaaccatggacaccttcaccatctactagatgctcataaatccactcaccattacgaatgtcagtagctactttaattatcggagcattacttcgcattacctcagtgagatagagttgctcaaaatctttatgagtaaagaatggagatagagctggaacagtacttcctggttctactgggcgaatctgagatttatcaccaatagcaataatcagacaccagcttggaattgttgccatgataatttggaaaagcttacggtcatacattgaagcttcgtcacaaattagaactcggcatttagccatgtccggaacttcactttgctcgaagagcatgttctcttcgtaagtggtcgggttaatcttcaaaatgctatgaatagtgttagcagccatacccgcaagcttactaagtactcgtttagctccgtgagtaggagcagctagcattacacccgatactccggttgaaatcaaataattgatgatgaactttgtcatcgtggtcttacctgtgccggcgggaccattaatagtgatgtgaccaccacgaccagctttaatacgttcaactacacgattgaacgtagccttctggccttcgttgagcatatcaaatgtaatattcaaaacttctcctacgcgactttaacctttttaacttgcaatgtgttaatcatttgttgaacatttcggcgctcttgttcagtgagcggtatatgttcaataatatcacgtttgaagaaaagccattttgtttcttggtactcaattttacgtccatacttcatcagatattgaagttttccaagttgagttccacaataacgctcagctgcatatttacctgtgaagataatacacattccaagtgggtctttatcccaagactcatagaacggaatctcaaatccgtctttatcttttgtaatcagcgcgtagccatagtgcatcacattttacctcgaataagttgaaacattgaagcagataatgggagacctttattcagcttagctttatcaataaaagataagttctggaagcgagttaatcccttaattactatatcataattatggacagaattttctgcttttgtggcctttttacttgtggttgcagcttttgaagccaacttatcagtgttcccagagactttacgaagacgcttaagttcagctttgccgccagtgatacgagcctgtaaagactttttcacttccgctggaacacctttctgcttcatatgatgctcacgcttggcgatattgttaagaatagccaagtattgtttgtggtactttttggcgatgccagctagcgggtcttctgattcaggttcttgttggtccacaatgacgtgaccgcccgcatctacagcacgaacaatgcgagaagctaactcatctcttttctcaataagctcctctaaggagaagtttccacgggcggaattgtacttcttcttaactgggatgacattacctggaacatatcctttgtcattgtcaaaacgctcaagtgtcatcatgtcatcgttaacgccttcaaggaatggctcacctgagtaagcacatactttctgttgagcaatgttagcaagatacgccatagttaatccaaaatctttttggcgtttcgtagctgaagcataagtgttaactaaacgagttgcaatgacaatttctaatggcttggccatatgatatccttatatgcttttgcgaaagtagcggtataatggtttcaaggagtattctatatcatccggttctggttgtaaacggtcagaatgaaataagttctacatcatagattgtatgcattccacctggattgaaattaacgtcctcaatgctagttactcggaacttcgttccgattggcatcatccattcctgttcatcctggaccatgttgattttattcttacggtcaatttttgctaaagggtcgtaaggtgctgcgctgaactcacaatttggagctgcagctaaaatctttagcatatcttcctgatagttataagctattgtagggttagaccagcgaatgacggtcttggtcccatagcatccaaagctagcaaaacttcttgctgtgtcgaagtcagttgaaaagcttacgactctttcagatgtaaaaacctctccaacttcgacgttttgaagaatattaagcattcgtctgttgacaccgcgataaagcacttcaggggtagcggttgtcatacgacggcggataactttatctaacccacgattaacccagtcttccactttatcattcaaacacttccacaaaactgcttgttcttcatcagtgaacatcgagttaacttcagactcgagcattttacgctcgacttcctctgaaccttcccaatactcatagattccaccagaaggaactggtattgatggtgtgatttctacttcaatgacaggactttgaaatgatgccatgataacctccgtttgtttacggaagctatcataacacagaagagaagggatgtaaacggttattttgcccagggagcccaaggcggcgggtctgcccacagtgaggacagttcttcacataaaggttttgtgtaatctaccccatgctttttgaagattagttctagctcagtagcgatactctggtccaccttcggaccagatttcatattagcctcaacatatccttcaggaatgtcttcttcaaacatatcgaaaatgttactcaacgcggaagtgcctccgttttaggaacacctaaaagatgccaaatacctctacgaaaaagaatcatatcaaattggtctgtgattaaccaattattcacatgtgtaattccgtatccatcagtatccatcatgtttggaattttcacagtatcgacgcttttatcaccaaacttgggctctggaataatgttaatcagattagtttgtggaattttccagccaccaagcaagaaactttcttgaacatcaaatggagaatttttagttttcacataagtgttgtattctttgatgataacatcaacaccttcaggccaaccatttttcaattcacttgggtcaacattatcacgacaaccagttccatattctaaaaatggattatagcagatagctaccatgatttcccttttatgaagaggatgccttttatcggtgaacgatggaaaatcgcgagaaacaaattccaacccgaatgtagtaattttgtattgtttatcagtcacaggtgaagcctccgccagtgtcacaggatgtatttgagggactatcaatatatgatgttgtatgtatcattggactatcagaataagatgctctggatgaactagagtgattctggtgattaactggagtatgagttacgcgtccagtataagtctgtccatttcgttgaactttctctttcttcgttattacttcttccatcattccgtcgcccatgtaaatccattcacgttgttcatttgcgccttcctcatatgcaacggccatatcattggctccgatatgctctttaatgctttcatctaatcgggtttcttccgctttgatttgggcatctggtcgaggattaccgaataaccctctcacaaaattcataatcattaacagctccaattctcaaagattgttctgacgtgtactttcttttggtctttccaataatacactcgaatttctaaagcagattctaacgaagtaccaacttctcgataagcatgaacaataacttctttgtaaaagattggaccattgcttccagaatgttcaagataagcatctgaaatcaaagtattgattccaccacaatcgcctatcggtttacgccatggagttgttttaacgttcatagtattttcctcgtttgtgaagtcattatacactactctataaaagcaaaaagggactcccgaaggagtccctaaatttgttaagatgcgggtccgttgaccagttcttcgttgaaagctacccaagcatcacgctgattgtactcgaacttggtagagaacagagcagtttctgtggttgagatgatgtacattgtaccagcaatcttgtgaacgtcggagtacagtttgaaatctactgaaacttctttcgctggaattgaagtgcctttaaacgtacgagctttggttttaatgttaacgtatggcataatagctcctttagtgaatatgcaatactatttattcactaagaacttatcggtaacactgaaataaccaccacctcgtacgaaaattacccaatcattgttaattaaaacggcagtgtatgcttcaagctcattaaatttccaatgtagacgtcggtcgtatgcatctgaacctttataaggagaggccggacgaccggccttctgccatgcataaaaatcaaatttcattaatagcctctttcttgacgagcaaagttctctgcatttttcagataatacagtttgaacacttcttcagctgtcataccaagagccataattttattcaggaagaagtgtaactggtcaatcaactcaaatttaatttcaagctggtcttctggtgataagtctttaattttcttagactgcatttctacatgttgagctttccaaggcttccacacagcagatgctgctttttcaccgttgctcataccaccgagtgcagtgtacaattcacgagtttcatctgcgatgtagtcgtcttgagcacgcaaccaagctaatacttcacctgcagtttccagagaatcgggatgacggttactgaatggtttatcttcagcaagacgaacttgaagagatttctgcatatcgagcattacttgcagagggtcttgatgattatcaattactgcattatacgcaccgtttgcttggtctacaccattaataagttgactacactcattgaaatgtgccatattaattttcctttcttgtaaaattttcaatcatacgtcgatagcatatatctgggtatcctgcttcgacagctattttgttaaatcgtgttcgtttaggtttattattataaacccatagttcataaagcgaatcatacgattcccaaatttttcctctacgaggatttggtaaaccatatctcggagaatctttacctttgaacctacctctacgagctttactcatattagacttagcatcttcagatataattttatctttatgagctaatctcattttagccttagtttcttctgatgcttttaatccttttatccaagatggtttaccaaacatcggattattttcgccagaagcatttaaagagttttgtattcttaaagtttctattaatctacttgttagtataataccatttttcttacgcattaaattaacagctaaatgtaaaccctttatatttggataaattttagttaataatctatgcgctacgaaatgttctctggctgtaaactcgactaaatttgagcattcatcacttccacccatacactttggaattatatgatgtgattctctatatccagttaagtttctgtatctagctttagataccaatgcatcatatattgcagaataattcattatttagcaacgaatccaaggttttcagacattttgcggaatttttccatcttttcaaatttcttccaaacttcttctctgtcttctacgaaatcaaaatcagtatgcactcgcaaattcagaagacaccccataatgtcgtttaattcagctattaatctttcacgattagttttgccttcatattctgagtcaattccaaactgaataatcttagagcaaagcattgctacttcagtacattcttcacctaacttaagaaaggcatgttgttctatgttcatattttagcataccgagtaaatctcatcttagccattaagcctgattcgatattgttgttgatgtaatccatgatttgttcaggtgtagcaccctctttcataatcatgtcattcacgtcttttgaagaccaaggtgacttgtcccaaaagacgactttttctccagcatcaataagcttcttcatacgctttattgtatctggatgacgaggttcatggtccataatccaagcacgattaccttcatacggaaccatgctcaactcaatagaaccaccagtaattgcgatagcattgttgatgaacaaactatctaatggcccttccataacaaacacaagtttattagggtctactgtgtcttggccataaatctttgtagcaagctcatgagctttaattgtcatgtatttttggggagcgtcttttgagagggctcgcccttggaaggattcaattttgcctttttcattaaagattggaataaccaagcgcggttcatttttctcatgtgagtatgtaccttcgtttactgagttaacgagagccggccattgagtagtaaaccacagtcggttccatttatctttaggaattttacgtccagcgatgtatttgcatattggatgagccggtgaaagcctatctaatcgctcacaataatcaagcttttgaatgaatttcttttcaaccggaggaagtttaacttctttcttaggagctgaacgagcttgaccttgttctttacgaacttcaagaatgtactctcgatataagtcaggttcattttctcgcagatatttagctaatcctaagtgtgcatcacagttatagcaatggactacaattccgccagttggttgttcatatgcccatccgcgagctttgaattggtctttttgtgagtcaccacaaattgggcaacgaaaattcaatttaaaacgatgaccgtttgttacttgtttgaatcttggaaggtgtgaaaatgcgcggtacgcaaactcgttatcaacccaactcactatattctccttagtggccttatttctaaggccattatatcacagtttattgagatttactttgatgcgcttacgtttctttggtagggtctcaggacctttattgacgattgctccggttgtggtaccagaggcgatattctggacacttccgccggaatctccggctaccatgtcctcgaacaagggaagagcctcaaatatctctttttgttctgattcagtgatattgtaacgtgaagctattgctgaccatgcactcatcatggatgctactccattgagtcctgggacagttgttaacattcttttgattgaacgcacagatgcgtggaaagcagtataagatgctttctcttctggagtagtaggtcgcttcagaaccgtacccttttcatcgattatcttggcttcatatgctttccattcagtgaatggtttttgcattagccggataaacttatacgcatagacggcgtcaataccgcttttaatagttgacatagtctcctcttctatttatcgtttaacacaaacgaatttagcagaggttgaaaaatcacgagcagaagtgcgccactcttcaccagcttggttgcacagttcttcggcagttggcccagtttgcgtcggtttaaactcaatttggttcatagcgactccgccgtgttcactaatgagagtcatgattaaaatgaatgtgtgcatcgtctttcctgctctgttttaattgcaaccaatattaaacctttacgataagattcacgagggtccgccggaaatccccaacgagtaagtcctgtttcaatttcacgctcaaagcgtagacgaagctgagccaattcagcgtcatgataatctacaaggtctctgccttcaaaaatcataagccaatccactctaaaacttctggaacagaagcattttcacaatacagatttgtgccagctactaccaggtcactttcacccaggtcttcgataagcatcttttggttcttatctgcaccagcttcaaggtcatgaatcagcttaggcttaactttgtcccagtcaccttcaacgaacttgatgcatggaattgaggtgtaatctgctttagccatagccggaacagcagagcatgatgatacagcaaagattagtgcaaatacgagctttttcattatgccaccgcgtgtttaacgttagttagacgaattagtttgaaatcgctgttagtaagagttccaacgccaatagtcacagcaccatgcttatcattaaacggaggaacaactacaaccacctgttcacccgcatcaagagcttctctaacaggaccttcacaatgtagtacagcattggctgatttaacaaccaaagttccagggagacagtctttgatttcagcttgtggtttggtgttgtcgtaagtgttgtttgcagcaattagtagttgattaagtgtcattttattgtcctcatctgtttttgatagggctatattatcatagccctacatgaatgtaaacggttagaatttaaggtcttcagccaatgcatcgagtttagctcttgcactagcgttttgttcaacacgagtcattcggttaccttctgcaactcgttgctgagcgccagaagtctctttgactgaagttggttgttcaccatgttcttgagctatttctacccaacgctgattgcctttacttacaccaatcaagaacttattgttgatgttcttgtcgccataacgagacttaatctgcttgatgagctgttgaccttgttgagcaagttcttcagtttcaattaccgctagcataaagtctgctgttgctggtagacccgcggattctgcaacatcactcattgaaacgtcagaagcatcccaacctgaacgagttgtctgagctgctgtccacaaaacagtttcagattcgacagccagagcacgaagttcttctgcaatagctttaactaatgtgtagctgttttcggtataaactttaatacgacaagaagcacagatacccagatagtcaataatgataacatcaggaacgaaattcttcttcagtttaagttcattcaataacgcacggaacgtatttgcatgagctccaccggttggatactgcttgataatcagacgaccaagagtattctttgagcgccatttttccatcttacctttgtattcagcatatgaaatatgaccatcatcaatatcgtccagcgatacatcaagtaagttagcatcaatacgttttgcgcaaacttcttctgccatttccatggagatatacagaacgttcttacccatctgaagatagtcagcagcaagagaacacagacctaatgacttaccaacgtttacaccggcgagtaatacgttcaaagtaccagtctctgcaccgccttttgtgattcggttcagaatattgagtttgaatgcaaccttacgagctttattctgataagctaaccaacgagcttcatggtcttccatccaatcatgaccaatgtaactatcaaatgaaattgacagagcagctcgcatgatgtctggaattgcacctacatcaggaagttttttgtttcgtttttctggtggaagctgggcgttagtctgaatttcaataatctttgatgttgcattgtacatcgcagattcttgaacaaaacgttcagtttcagctacgagccagtttaaatcttctggagtatcttgaagcttattaattaactcacttgcgccctgtacttcagtttcaaccaactgactattatccaaagccactgtcaatgcagttttacttggaacagcttgatatttaagaacgtgctgatgaatcagtttgaaaacatttttggctgggccatgttcaaaatactcatctcccatataaggccaaaccttcgcgaagaaggcttggttatacagcaaatgagataagattgtttctaccacgggaacctcattaaaatagtttgaaacgttttttctttctcataatctcggcatgagcctgttgaatttgtattttaatacatttttcaacatgtggtgcaaggtcggcttttcgtgattcgtctaacgtagagaactctagtgacacctggccgctttcatccaagtgtaatgaggtaacatatacgatatgttcctcgccatcttctagggttatcaggatttcctgaacgacattctccatagccttttggactatttctagactctttttaaacatccgctcggttctttcaaattccccctcctgagagggggtttcgtcctgaacttcaacttcagtcaaatcgaggtctaagtcctcgaaattattcttcatcgtaattttccagttcatcttcgattgaagctggagttgctcttacttcgccttccggagcatggaactcttcggtcttcgaattaatcagagcatcaacttcttcatctactattgcattggtttcaatagcacccagctgatagcgatttttaatagcatcgcggaatggctgatgtttaaacagagggccccagaatgctgtgcttgaagtatcttttgcacgccatgatttctcttcgcgaaccatttcaccggtatctacgtccagatattcacgagcataccaaccgtttttaggtttaactacaaaaccaagttccagcgccatatccaacagaccagagtatgggtcaataccgccatcgaatttaacatcaatgaagaacttactcttctctttaacagtacgagatttctcagcattcagaacaaactgataaccttgaaggtctgtaccatctttaatctgacgcttaccgatgatgaacacagtatctgctgagtacattggacctgtgttatgagtaacgataccattttctaatacataatgctctacacccgcaacagacaaatcataaacttcttttttacccacagctttaacagatttaattttcatagtttaccttgaatttcatacgaccaaccttcaacaccatttctgatgtttttgattattgtatttttgttaattcctaattctcgcgaagccggtcgaacgcctctatacttgacaccatttattataacacccttttgacgaggatgagaattagctaaacgttttgatgctttttctgcaatagtgttaagagtttcttcagagtgtttacgcccataaaatccgttattttcgccagaaatacccctagatatagcagctttatgatctttagaaagctttttatcttttgttactccaacatactcgccgcttaaaactgcttcatgattaataggcaaacgaatacattttccggttacgcagtgtttgtatgttccataatttgatttagcgtatgaattatgaccgcatgcataatctaaattaaaataatctggattagtctttgctctacactcatattgatatctgctctctattgacaataaatcttcattagaaatattttcatattcttcaagtatttcaattgtagtattttcgtcaataaatgaatgatagccaggatatcttgaagaaccaaaatactccttaccattttcttcaatgattttaccattaatatgtttggctttagttttactaccaatgtaataaaatggcggagtattttgtttaatacgggaattaaaaataactttatagatatagttcatatggataccttgagtacattagttcggtatccatatttatcacctaattacacaatccattccagctactaagtctttggcttcaacccatacaggaatatcttttgtcataacaaggaatttatgcgtatctgaagtagtaactttatatccatcttcaaattcaatttcaaaacattcgggagtgccttcagctagagtttcggggtcccaaacataagttacttcattatcaccaaccatggttttaactcgttcacctggcttaatatcttctacttttttagtagtgccattagccatttgaattttagtacctgcaacaacgcaaccaccagtcatcacagtcttactgaacatctcaattgtttcgattgtgtggttaaccgcaacgcatggaatgtttttaatagagaagtaaggtgtaacaatacggaatagagacttcagtgatttcgcacgagtcatatctgcaactgatttttcgttcagagcatcttctgtttctttcttagaagcaaggttaccgatggagtcgatgaatacgataactttctcaccgcgttcaatttcttccagctggtttaccatgtcaatcttaagctgttcaacagattgtacaggagtgtgtactacacggtccgggtcaacacccattgcacgaagatatgctggagtgataccgaattctgagtcgtagaacagacaaatagcatccgggtattttgtcatgtaagcggaaaccatagtcagactcatatttgacttgaagtgctttgacgggcccgcaaagattgttaaacctgattgcatgccaccatctaatgcacctgaaatcgcgatattaagcatcggaatcttagtacgaactacatccttttcattgaagaatttggatttatccagagatgcggtcattttagaagtggatgctttaatcagacgagattttaaatcagacattaattattttccataagtctccataatatttttctcacaggtttaagatagagtaattatatcaactacggtttaaagcggattgcaatgcggtgaatcattttgacaaggtgtgtaacaacaagcattacaatgaccaccgactctgtcggtggtgtattctttagatttcaattgctttcttgaattcagcttgccaaattggtttttcatcaagatatttttgaagaattttatgctgatattcgagagtttcaattctaaagtcctcgtcgtttttgattttattaattttgtcaacaagctcttgacgattgctcacatagaagaactcattaccttccatgatattcatgtcagggtcaaatgtgctatcgaagaatgccactgcagtagatgccagagcttcccatacacgaggagtgatttggttattatcgtaagtcttatcaccgagtacgatagtagcatacgcggttgagttacgttgaaccatttcacgagaatctaccttcccaggaaatactggaggagtagtccaagggaattccggattcttgaattggtctgcctttactgaaccaaagaactcaacatccaggccagtgtcaaacagatattcaaccatcttagcttcacgattacctgaacggaatgttccaccataaatcaggtcacgcattttgattccatcagcagcaatcttgaagacgctgtgatacatcttatgacggtccagtgcaaaatgaacaaattccattcggtccttagagacaccaactaaacggtcagagtgaattcgtttagcttgttccaggtcgcggccttgagaaattacacgaattggagagcgaacaatgaactgctcttcggtgtatttgctggaccattttttcttcgacattcgacgccaagcttgttcccatggaagacgaatatcagtgaacagataataaatctttgacttatatttgttcaagaacatataagccgctttattcatcttgttctcttcaccaccgtagaagttcagagaagcattaactaccagaactcggtcatatacattcgggtctgggacatcatcaaatgcgatgccatattgagtatttttcattgaaatgaggtcaacatcaagccccatatcttttaagcattcagacagataaattgtctcagaagcaggggttgttttaaacccctggatgttgttacctaagttcaggatagcaattttcataaagtaggctcaatctcactgaattttttgaaagcatctgacttttgtttcttggctacgcacatacgaagtactttcagaggctcgtcagtgccaaacatagttttggttgggtcaccttctgatttccaacgagcttgagttgggaagtcagcatgaattttttctaatgcgcgattttgtttagccgcattacgcatagatgatacgccgccaggagcttgtcctttgccagatttgacgagatatttgaaaatcgccagatgaggataacccatattaatgagtttaaggaatgcgtatgtatcttcggacaggtctactataccatatccaatgtcatcagcagaaagtttgcttaaatcgtaaaaagtgttagtgaatccataagagttctcacggaaatgaccccacttagaatcaatcttgaaaataggcaaacgagcatggccgtgatagaatccacagtccatagctgcttcaacatactgcgtgagtttattgaattcgtcccatgtcattccaacatcatgaagaatacgacggtcgtctttagcacgaatctcagtagtatgaattgtagtgtcgtcgtccagcatccaaattcgttggccttgatacatttcagtaatcaaacgacgagtaccagcaatgccatttacatcatctggaatagttacgattttagccaacgcaccgtaatgcatctcatattcttctttctgagactcacgaactactaaatgaggtacataaccagtagggaacatatccagggcagttactgccccgacacgattgtaactcggaattacaaattgaatcattgattttttcctatacacgcggattttccaatcccatgtcggtcaatccgactaggaggaacctttttatgacagaatatgcaataaaattctattctatttggagatattctaccacgcagagaattagcaattttatctttagattcttggctaagacttctaccaattaaactttttgaaatattcgattttctttcatcagaaaattcaaaagtcattcccttcgttgggctaggtcttccttttaatttacgagatacttcagtatagtctatttttgaagttcttttctttatgtgctcatctgattgtttatagcctgaaatggggcgtgcacccaaccaatgtttgcataaagaattatacgccatagcatcttcatacttgccgtattttttaaataactctaaatgagcccgagcgtgttcctcgggcgtaagataaactaaattgctgtcatcatcggttccgccagcatgtctaggaatcacatggtgtctatgatatcctggacgctttggtatcatttccacttgcctttatagtcagatttcttgacattaatttggccagtttgacgataatgatcaactagatagaagtgccgagaatacacgtgcagagacccagcgttccaaataatgtcgcctggaacatacttttcaccagaacctgcattaactgtttctactaatgattctaatacatatttctgccaagcataatcattgcggaaaccaaatacaacatcattgcttcgcatattaacgatagcgtttacacgaccatcacgaataagatattgaactgtgttagtgcacatgaaatcactcataccatcacgttcaaaatcaacttgcatacttggacgagtgtaaatcataattgcacgacgagaatctggtttttcaatcagctcagttgcacagaatgagaattgattatagttttcagcagaccaaatagcccagccgtagtttgagttaatttcaccctttgaagatgaaacctgttcccaaatcgccggagtaccgcctggaatatctttcacgaacagagacttggatttgtaccatgcaagttcacgttcaacatattcttggttaactgttccgaaaattgaatcttcggttactacaaaagatggaccaattaactcaatggtctttgcgccagttttgtcaattacaaacatctcattgaacagagcatggcacagttcatcacgaatgtcttcgttagtcagtggagttacaatcattttgcctcttcgtagtttttcttcatacaacgcttaaatgcttcatattggccagaagacctgaagttttcaaatgcattgatatttttgctggtaggattattatacatcgtttgatataagcctgcaccatggaactcaacgatagcttgacacttacgagcagctacttgcttctcataggttgcgtcaaattcgcgttgtttcttcatgacacgtgcttggtcacgagcgatagggtcattagcctgctgttgagcaagataatcttcgcctgcacgaacagaagactgattgatttgaggggttgaacgagcatacaccagaccggtgccgcctacatacttaacttgccctacactactagcatgaacagtgtctccttgataagcacaacctgccagtaacatagcagcagctactgctaaaaatttcatttcaatatcctcatttgtgtatagaagaattataccacatccttgtggtaatgtacaatgctttagaaatcaaacatattgtctaaagatgctttctcttcgtaatcaagacctgaagcttctgacataccagcaagaggcttaacgaaagacttttggaacagagtcgtatagtccaaccaagccagaacatcttgacgaatttcctgtggaagttcagtacctgatggccaggcgatacacttgtcaccgaatgggttaccctgacgaagtggaagaaccatcaccttgttaccctcgagaatcggagtgacagagaatcctgccgttgcacgattataagtcagtgcaccacggacgtgatacgggcatttcagaccagggaaaccattatcgtcatatttaccgatgtcattacaagttttaacttctgcaataactttgtagtccagctgacgatattccttctcaaactgtttgtagtattcttgcagtgattcttcgccttcttgaaccatacgacgaatactttcttccagtgctttctgaaccgcttttggagtagaagattgctgagtttccatgcccataatcttcagatgtggttcagcataacgcttatcttccatgtcgtaaacgttcagtgcataacgtttcttagctttccagaatccaccacaaccttttgaaccaagcggcggacaagaaatagcttctcggtccatgtgcataagatgttcacggttattgaagtactcgcacagttcacgataagcagtatcaatcatcggttccattttcttcttaccgaattggttcatgaattcaaccacttcgtcagtcgttttgaaacgttcaagacctactttttcaataaccttgtcaactgaaacgtagattgagtcagtatcacctgctgcgatgaaatcaaatccttcagttccacacaccttattcagatactcgttaactttacgagcaatccaacgaatacctacttgaccaaacagtgtaatcgcagatgcgttacgaaggtcataataacggaagtagatgttacccaaagcgccataaagactgttgataagaatcttacggttcaactggtttgtgtttgctagaatagcagcagcttcacatcgagccagcatagtttccaacaccaacttcgtgtacttattcagagacgctttctgttcgtcagtgtactgagtgtaacgagtttcatctggagtatcaatgtcaccgaatacgccagctgccagaactttcttaatttcttctgcgttacgttcttctgcgaacatctttttcttccaatctttacgctggaagaataccttagcgatttctactgggatgacaccttcaatatctttacgatacatccaaccgttcggtgagcaagaatactcgtcacttggacgtggtgcagtcttattgatataagcttcaatatcataaagtttgaattgaccaacaatagtttccggagaaatattcacctgacgaatgatactcggatacagagatgttaagtcaaaactcatgatgtacttacgagcacatgctaatggttcaaatacatatgcacctggataactttgcttgatatgacgcttaccttgaggaacaactttgttctgttctttcaaggagttaaagatgattgcgtcccaagttttaattggagacattacaccaccgaacggcatcttagcataataagacatactcagtgccaggtcaatgaatccacgaactcggtcaataccacctacggactcaacgtccataatgttatagctaatgtatcgttggtgatttgtttcacgaagtttgttaattggaccatcgtatggcaacttaccacgtttagtctcgtacagagcgatgtagtccaagttataagttggttggttcgtgaatgaatacttcttgtacaaatccatgtaatccagaattgttacaccatcaatgctgaatacttctttttcaccgtacatgttctgaatgagttttgaattcactcgattgattggagagaatcgtttcattgaacgttcacccaatacatgcttaacacggttcatgatgtatggaatatcgaagacttcaatgttccagcctgtgaaaattgctggacgcttttgttcccagagattgatgtattccagaagaagttctttctctgaatagaatggcatgtacactacacggtcgagaatatgttgtggaacttcatcaccaccttctttatcacttcgtgcagctaacttcgcgtcccattctgaaactgagccatacagagaatctaacaaatcgaaaacgtagaacttatcatcgattgaatcataatgagtgattgcatcgatttcgtacatagctttcattgggtctgggaatttatcacctgtaacttcgatgtcacagttcgcaacacgaatgaatttcttgtcatagacaatttcagaaccataagtgtcagagatataagcaagtttgaagtcatccatacccatggcttcaagaccgatatcttccatacgacgaatccaatcacgagcatctttcatggttgggaatgtgtttttgacacacggtttaccgtagatatcaaagaactttgtcttcacgccttgttgagcatgagaaaacatagttggagaatattcaattcgtcgctgacgttctacaccattagagtcaatataacgttcaatgatgtcattacctgcggtttcaacagagatataaaattcttgtgccatgagtttccttagtttttcctatagaccgagtgattggtctttggtgtgtctattatactccgctctgccgatagcagaaagggcccgaaggccctctttagatttgtgaagcttcgtattgaactacgccttcttcgtctttccaatacgccatgaaagcgtaaccatcaggataaactcgttttccatctggagtcatggccgtgcgaagttgttctttttgacgttcaatttgctcttctttagtaccttcaaacattatgcacctatcgtgtattttgatttgagagtccattcagatttctgctggaatgtgataacgcggaagttattctgcatttcagcaagatgaacatccggagtcacgatatcaagtaagccccatccttgtaacagttgggcaattgaatctcgacggatgtagtcttcagaatcgatagtaacaggacgaccatcaagcttcaacatttctttgaagtgaacgatgtagtacttgccctgtttctgaagaatgtggcaactttgatatagtaccttatctttgttattagcaatacccatacgagttagggtttctttcactttcagaaaatcttcaggttgtttcagagtaatttcaatcattttaccattccaatgctaattttttaagttgcttttgttctttcacgtttttggtaatgcttttgactagctcatcagtcactgtacctttaagacgttttaatgtctcagacagtttatttttgttggctagagtcgctctataacgctcagcgtcattgatattgattgtataatgattcatcaatactttcagaatgagtgtctcctgggcgctctcgtttaacttagcccacttaccaaaacggcgtcctctaggaacagccgctttcagataattgaaatgagcttcatctgacaatccagaaccaactaaattcatcacataaactgatggcatgcattctggaaattgagatagagcattttctaccatgaacttcgaataatcacgagttccgattgatatatctttcttctcgttaattgcaccgattattgcgaagaattcattttctgctgtttctttgaaagtatcagagagacgtttaatctctgcctcgtctttactataccaagcaatctggtgttcgttcagctgaacatcatcttcgaataaactcatttgaattgcatctctacaacaagttgcatgaacatataagttatgtgcagttctgtcgaagctgctacaccatgatattgattgttctcaccgacaatctcatacatcctgatgatacttgctttatcaactttcgtgtaaagctcgttggcaagtttctcgataaaccaagaataattagtcgcgtacttaggagctagtgcacgaagttgtttaacatcttttgatttcagtgcatcaataacatcactgatatctccagaagtttttgtcaccaaatccaaaattccagagtcaataacgcctttggaagaataatggtccaaatcaccaatcgtcttacgaaaatctgggaagttcttgttaaccaatgccgcgatgactttaaggtcttcaaccttgatattttcatttttacagatttctacacaacgacgaatcatctctttcatcatgttgcgtttatcatcatcagtcgcttgaccgaatttgataacacggcaacgagattgaagtggttcaatgataccgtcgatgttgttagcagtgatgatgattgtgcagttgcttgaataagcttccatgaaagaacgcaagtgacgctgagattcagcaagacctgaacggtcaaattcgtcaatcacaataactttctgcttaccagataatgaggcagcagttgcaaagtttgtcagtggtccacgtacgaaatcaatcttacaatctgaaccattaacgaacatcatttcaacaccgacgtcgttacaaagtgcttttgctaaagtagttttgcctgtacctggagatgcagataccagaatcatatgagggatggtgcctttcttgatga

What is claimed is:

1. A composition, comprising:
a pharmaceutically-acceptable carrier; and
greater than or equal to $1 \times 10^4$ PFU of each of a plurality of bacteriophages, the plurality of bacteriophages comprising:
a first bacteriophage having a genome with greater than or equal to 80% sequence identity to a first one of SEQ ID NO:2, SEQ ID NO:3, SEQ ID NO:5, or SEQ ID NO:6;
a second bacteriophage having a genome with greater than or equal to 80% sequence identity to a second one of SEQ ID NO:2, SEQ ID NO:3, SEQ ID NO:5, or SEQ ID NO:6;
a third bacteriophage having a genome with greater than or equal to 80% sequence identity to a first one of SEQ ID NO:1, SEQ ID NO:4, SEQ ID NO:10, or SEQ ID NO:14;
a fourth bacteriophage having a genome with greater than or equal to 80% sequence identity to a second one of SEQ ID NO:1, SEQ ID NO:4, SEQ ID NO:10, or SEQ ID NO:14;
a fifth bacteriophage having a genome with greater than or equal to 80% sequence identity to a first one of SEQ ID NO:7, SEQ ID NO:8, or SEQ ID NO:9;
a sixth bacteriophage having a genome with greater than or equal to 80% sequence identity to a second one of SEQ ID NO:7, SEQ ID NO:8, or SEQ ID NO:9;
a seventh bacteriophage having a genome with greater than or equal to 80% sequence identity to a first one of SEQ ID NO:12, nucleic acid bases 1-59,985 of SEQ ID NO:13, or SEQ ID NO:15; and
an eighth bacteriophage having a genome with greater than or equal to 80% sequence identity to a second one of SEQ ID NO:12, nucleic acid bases 1-59,985 of SEQ ID NO:13, or SEQ ID NO:15.

2. The composition of claim 1, wherein the first bacteriophage has a genome with greater than or equal to 90% sequence identity to the first one of SEQ ID NO:2, SEQ ID NO:3, SEQ ID NO:5, or SEQ ID NO:6 and wherein the second bacteriophage has a genome with greater than or equal to 90% sequence identity to the second one of SEQ ID NO:2, SEQ ID NO:3, SEQ ID NO:5, or SEQ ID NO:6.

3. The composition of claim 1, wherein one or more of the plurality of bacteriophages is present at greater than or equal to $1 \times 10^8$ PFU.

4. The composition of claim 1, wherein:
the first bacteriophage has a genome with greater than or equal to 90% sequence identity to the first one of SEQ ID NO:2, SEQ ID NO:3, SEQ ID NO:5, or SEQ ID NO:6; and
the second bacteriophage has a genome with greater than or equal to 90% sequence identity to the second one of SEQ ID NO:2, SEQ ID NO:3, SEQ ID NO:5, or SEQ ID NO:6;
the third bacteriophage has a genome with greater than or equal to 90% sequence identity to the first one of SEQ ID NO:1, SEQ ID NO:4, SEQ ID NO:10, or SEQ ID NO:14;
the fourth bacteriophage has a genome with greater than or equal to 90% sequence identity to the second one of SEQ ID NO:1, SEQ ID NO:4, SEQ ID NO:10, or SEQ ID NO:14;
the fifth bacteriophage has a genome with greater than or equal to 90% sequence identity to a first one of SEQ ID NO:7, SEQ ID NO:8, or SEQ ID NO:9;
the sixth bacteriophage has a genome with greater than or equal to 90% sequence identity to the second one of SEQ ID NO:7, SEQ ID NO:8, or SEQ ID NO:9;
the seventh bacteriophage has a genome with greater than or equal to 90% sequence identity to a first one of SEQ ID NO:12, nucleic acid bases 1-59,985 of SEQ ID NO:13, or SEQ ID NO:15; and
the eighth bacteriophage has a genome with greater than or equal to 90% sequence identity to the second one of SEQ ID NO:12, nucleic acid bases 1-59,985 of SEQ ID NO:13, or SEQ ID NO:15.

5. A composition, comprising:
a pharmaceutically-acceptable carrier; and
greater than or equal to $1 \times 10^4$ PFU of each of a plurality of bacteriophages, the plurality of bacteriophages comprising:
a first bacteriophage having a genome with a first tropic element having greater than or equal to 80% sequence identity to a tropic element of a first one of SEQ ID NO:2, SEQ ID NO:3, SEQ ID NO:5, or SEQ ID NO:6;
a second bacteriophage having a genome with a second tropic element having greater than or equal to 80% sequence identity to a tropic element of a second one of SEQ ID NO:2, SEQ ID NO:3, SEQ ID NO:5, or SEQ ID NO:6;
a third bacteriophage having a genome with a third tropic element having greater than or equal to 80% sequence identity to a tropic element of a first one of SEQ ID NO:1, SEQ ID NO:4, SEQ ID NO:10, or SEQ ID NO:14;
a fourth bacteriophage having a genome with a fourth tropic element having greater than or equal to 80% sequence identity to a tropic element of a second one of SEQ ID NO:1, SEQ ID NO:4, SEQ ID NO:10, or SEQ ID NO:14;
a fifth bacteriophage having a genome with a fifth tropic element having greater than or equal to 80% sequence identity to a tropic element of a first one of SEQ ID NO:7, SEQ ID NO:8, or SEQ ID NO:9;
a sixth bacteriophage having a genome with a sixth tropic element having greater than or equal to 80% sequence identity to a tropic element of a second one of SEQ ID NO:7, SEQ ID NO:8, or SEQ ID NO:9;
a seventh bacteriophage having a genome a seventh tropic element having with greater than or equal to 80% sequence identity to a tropic element of a first one of SEQ ID NO:12, nucleic acid bases 1-59,985 of SEQ ID NO:13, or SEQ ID NO:15; and
an eighth bacteriophage having a genome with an eighth tropic element having greater than or equal to 80% sequence identity to a tropic element of a second one of SEQ ID NO:12, nucleic acid bases 1-59,985 of SEQ ID NO:13, or SEQ ID NO:15.

6. The composition of claim 5, wherein:
the first tropic element has greater than or equal to 90% sequence identity to the tropic element of the first one of SEQ ID NO:2, SEQ ID NO:3, SEQ ID NO:5, or SEQ ID NO:6; and
the second tropic element has greater than or equal to 90% sequence identity to the tropic element of the second one of SEQ ID NO:2, SEQ ID NO:3, SEQ ID NO:5, or SEQ ID NO:6.

7. The composition of claim 5, wherein:
the first tropic element has greater than or equal to 90% sequence identity to the tropic element of the first one of SEQ ID NO:2, SEQ ID NO:3, SEQ ID NO:5, or SEQ ID NO:6;
the second tropic element has greater than or equal to 90% sequence identity to the tropic element of the second one of SEQ ID NO:2, SEQ ID NO:3, SEQ ID NO:5, or SEQ ID NO:6;
the third tropic element has greater than or equal to 90% sequence identity to the tropic element of the first one of SEQ ID NO:1, SEQ ID NO:4, SEQ ID NO:10, or SEQ ID NO:14;
the fourth tropic element has greater than or equal to 90% sequence identity to the tropic element of the second one of SEQ ID NO:1, SEQ ID NO:4, SEQ ID NO:10, or SEQ ID NO:14;
the fifth tropic element has greater than or equal to 90% sequence identity to the tropic element of the first one of SEQ ID NO:7, SEQ ID NO:8, or SEQ ID NO:9;
the sixth tropic element has greater than or equal to 90% sequence identity to the tropic element of the second one of SEQ ID NO:7, SEQ ID NO:8, or SEQ ID NO:9;
the seventh tropic element has greater than or equal to 90% sequence identity to the tropic element of the first one of SEQ ID NO:12, nucleic acid bases 1-59,985 of SEQ ID NO:13, or SEQ ID NO:15; and
the eighth tropic element has greater than or equal to 90% sequence identity to the tropic element of the second one of SEQ ID NO:12, nucleic acid bases 1-59,985 of SEQ ID NO:13, or SEQ ID NO:15.

8. The composition of claim 5, one or more of the plurality of bacteriophages is present at greater than or equal to $1 \times 10^8$ PFU.

9. The composition of claim 5, wherein the plurality of bacteriophages comprises at least 14 different bacteriophages having respective genomes each with a tropic element having greater than or equal to 80% sequence identity to a respective tropic element of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

10. The composition of claim 5, wherein the plurality of bacteriophages comprises at least 14 different bacteriophages having respective genomes each with a tropic element having greater than or equal to 85% sequence identity to a respective tropic element of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

11. The composition of claim 5, wherein the plurality of bacteriophages comprises at least 14 different bacteriophages having respective genomes each with a tropic element having greater than or equal to 90% sequence identity to a respective tropic element of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

12. The composition of claim 1, wherein the plurality of bacteriophages comprises at least 14 different bacteriophages having respective genomes each with greater than or equal to 80% sequence identity to a respective one of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

13. The composition of claim 1, wherein the plurality of bacteriophages comprises at least 14 different bacteriophages having respective genomes each with greater than or equal to 85% sequence identity to a respective one of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

14. The composition of claim 1, wherein the plurality of bacteriophages comprises at least 14 different bacteriophages having respective genomes each with greater than or equal to 90% sequence identity to a respective one of SEQ ID NO:2, SEQ ID NO:3, SEQ ID NO:5, SEQ ID NO:6, SEQ ID NO:1, SEQ ID NO:4, SEQ ID NO:10, SEQ ID NO:14, SEQ ID NO:7, SEQ ID NO:8, SEQ ID NO:9, SEQ ID NO:12, nucleic acid bases 1-59,985 of SEQ ID NO:13, and SEQ ID NO:15.

15. A composition, comprising:
  a pharmaceutically-acceptable carrier; and
  greater than or equal to $1\times10^4$ PFU of each of a plurality of bacteriophages, the plurality of bacteriophages comprising:
    a first bacteriophage having a genome with a first tropic element having greater than or equal to 80% sequence identity to a tropic element of a first one of SEQ ID NO:2, SEQ ID NO:3, SEQ ID NO:5, or SEQ ID NO:6;
    a second bacteriophage having a genome with a second tropic element having greater than or equal to 80% sequence identity to a tropic element of a second one of SEQ ID NO:2, SEQ ID NO:3, SEQ ID NO:5, or SEQ ID NO:6;
    a third bacteriophage having a genome with a third tropic element having greater than or equal to 80% sequence identity to a tropic element of a first one of SEQ ID NO:1, SEQ ID NO:4, SEQ ID NO:10, or SEQ ID NO:14;
    a fourth bacteriophage having a genome with a fourth tropic element having greater than or equal to 80% sequence identity to a tropic element of a second one of SEQ ID NO:1, SEQ ID NO:4, SEQ ID NO:10, or SEQ ID NO:14; and
    at least one pair of bacteriophage selected from the group consisting of:
      (i) a fifth bacteriophage having a genome with a fifth tropic element having greater than or equal to 80% sequence identity to a tropic element of a first one of SEQ ID NO:7, SEQ ID NO:8, or SEQ ID NO:9; and
      a sixth bacteriophage having a genome with a sixth tropic element having greater than or equal to 80% sequence identity to a tropic element of a second one of SEQ ID NO:7, SEQ ID NO:8, or SEQ ID NO:9; and
      (ii) a seventh bacteriophage having a genome a seventh tropic element having with greater than or equal to 80% sequence identity to a tropic element of a first one of SEQ ID NO:12, nucleic acid bases 1-59,985 of SEQ ID NO:13, or SEQ ID NO:15; and
      an eighth bacteriophage having a genome with an eighth tropic element having greater than or equal to 80% sequence identity to a tropic element of a second one of SEQ ID NO:12, nucleic acid bases 1-59,985 of SEQ ID NO:13, or SEQ ID NO:15.

16. The composition of claim 15, wherein the at least one pair of bacteriophage comprises the fifth bacteriophage and the sixth bacteriophage, and wherein:
  the first tropic element has greater than or equal to 85% sequence identity to the tropic element of the first one of SEQ ID NO:2, SEQ ID NO:3, SEQ ID NO:5, or SEQ ID NO:6;
  the second tropic element has greater than or equal to 85% sequence identity to the tropic element of the second one of SEQ ID NO:2, SEQ ID NO:3, SEQ ID NO:5, or SEQ ID NO:6;
  the third tropic element has greater than or equal to 85% sequence identity to the tropic element of the first one of SEQ ID NO:1, SEQ ID NO:4, SEQ ID NO:10, or SEQ ID NO:14;
  the fourth tropic element has greater than or equal to 85% sequence identity to the tropic element of the second one of SEQ ID NO:1, SEQ ID NO:4, SEQ ID NO:10, or SEQ ID NO:14;
  the fifth tropic element has greater than or equal to 85% sequence identity to the tropic element of the first one of SEQ ID NO:7, SEQ ID NO:8, or SEQ ID NO:9; and
  the sixth tropic element has greater than or equal to 85% sequence identity to the tropic element of the second one of SEQ ID NO:7, SEQ ID NO:8, or SEQ ID NO:9.

17. The composition of claim 15, wherein the at least one pair of bacteriophage comprises the fifth bacteriophage and the sixth bacteriophage, and wherein:
  the first tropic element has greater than or equal to 90% sequence identity to the tropic element of the first one of SEQ ID NO:2, SEQ ID NO:3, SEQ ID NO:5, or SEQ ID NO:6;
  the second tropic element has greater than or equal to 90% sequence identity to the tropic element of the second one of SEQ ID NO:2, SEQ ID NO:3, SEQ ID NO:5, or SEQ ID NO:6;
  the third tropic element has greater than or equal to 90% sequence identity to the tropic element of the first one of SEQ ID NO:1, SEQ ID NO:4, SEQ ID NO:10, or SEQ ID NO:14;
  the fourth tropic element has greater than or equal to 90% sequence identity to the tropic element of the second one of SEQ ID NO:1, SEQ ID NO:4, SEQ ID NO:10, or SEQ ID NO:14;
  the fifth tropic element has greater than or equal to 90% sequence identity to the tropic element of the first one of SEQ ID NO:7, SEQ ID NO:8, or SEQ ID NO:9; and the sixth tropic element has greater than or equal to 90% sequence identity to the tropic element of the second one of SEQ ID NO:7, SEQ ID NO:8, or SEQ ID NO:9.

18. The composition of claim 15, wherein the at least one pair of bacteriophage comprises the seventh bacteriophage and the eighth bacteriophage, and wherein:
   the first tropic element has greater than or equal to 85% sequence identity to the tropic element of the first one of SEQ ID NO:2, SEQ ID NO:3, SEQ ID NO:5, or SEQ ID NO:6;
   the second tropic element has greater than or equal to 85% sequence identity to the tropic element of the second one of SEQ ID NO:2, SEQ ID NO:3, SEQ ID NO:5, or SEQ ID NO:6;
   the third tropic element has greater than or equal to 85% sequence identity to the tropic element of the first one of SEQ ID NO:1, SEQ ID NO:4, SEQ ID NO:10, or SEQ ID NO:14;
   the fourth tropic element has greater than or equal to 85% sequence identity to the tropic element of the second one of SEQ ID NO:1, SEQ ID NO:4, SEQ ID NO:10, or SEQ ID NO:14;
   the seventh tropic element has greater than or equal to 85% sequence identity to the tropic element of the first one of SEQ ID NO:12, nucleic acid bases 1-59,985 of SEQ ID NO:13, or SEQ ID NO:15; and
   the eighth tropic element has greater than or equal to 85% sequence identity to the tropic element of the second one of SEQ ID NO:12, nucleic acid bases 1-59,985 of SEQ ID NO:13, or SEQ ID NO:15.

19. The composition of claim 15, wherein the at least one pair of bacteriophage comprises the seventh bacteriophage and the eighth bacteriophage, and wherein:
   the first tropic element has greater than or equal to 90% sequence identity to the tropic element of the first one of SEQ ID NO:2, SEQ ID NO:3, SEQ ID NO:5, or SEQ ID NO:6;
   the second tropic element has greater than or equal to 90% sequence identity to the tropic element of the second one of SEQ ID NO:2, SEQ ID NO:3, SEQ ID NO:5, or SEQ ID NO:6;
   the third tropic element has greater than or equal to 90% sequence identity to the tropic element of the first one of SEQ ID NO:1, SEQ ID NO:4, SEQ ID NO:10, or SEQ ID NO:14;
   the fourth tropic element has greater than or equal to 90% sequence identity to the tropic element of the second one of SEQ ID NO:1, SEQ ID NO:4, SEQ ID NO:10, or SEQ ID NO:14;
   the seventh tropic element has greater than or equal to 90% sequence identity to the tropic element of the first one of SEQ ID NO:12, nucleic acid bases 1-59,985 of SEQ ID NO:13, or SEQ ID NO:15; and
   the eighth tropic element has greater than or equal to 90% sequence identity to the tropic element of the second one of SEQ ID NO:12, nucleic acid bases 1-59,985 of SEQ ID NO:13, or SEQ ID NO:15.

20. The composition of claim 15, wherein one or more of the plurality of bacteriophages is present at greater than or equal to $1 \times 10^8$ PFU.

* * * * *